United States Patent 11,098,302 (IDENTIFICATION OF POLYNUCLEOTIDES ASSOCIATED WITH A SAMPLE) - sequence listing, part 180

SEQ ID NO: 786639 - DNA, 469 bp, Homo sapiens
  misc_feature: NA.17.20.B09.1.454.heavy.3.zerom50
agggggggagaggagcccagcactacaagtcggcggtgtttccattcggtgatcaacactgaacacagaggactcaccatggagtttcggctgcgctgggtttttctcgttgctcttttaagaggtgtccagtgtcaggtgcagctggtggagtctgggggaggcgtggtccagcctgggaggtccctgagactttcttgtgaagcgtctggattcaccttcagtgcctatggcatgcactgggtccgccaggctccaggcaagggggctggagtgggtggcacttatatggtatgatggaaataataaattctatgcagactccgtgaagggccgattcaccgtctccagagacaattccaaggacacggtgtatctacaaatgaacagcctgagagtcgaagacacggcgacttattactgtgcgagagatctgggtgcatatagtgacggttttatgccgttgccg

SEQ ID NO: 786640 - DNA, 484 bp, Homo sapiens
  misc_feature: NA.19.6.A06.1.454.heavy.3.zerom50
agggggagagaggagcccagccctgggattttcaggtgttttcatttggtgatcaggactgaacagagagaactcaccatggagtttgggctgagcgtggckttttctakgtggctattttaaaaggtgtccagtgtgaagtgcaactggtggagtctgggggaggcttggtacagcctggggggtccctgagactctcctgtgcagcctctggattcacctttagcaactatgccatgacctgggtccgccaggctccagggaaggggctggagtgggtctcagttattagtgggagtggtgggggaacatactacgcagactccgtgaagggccggttcaccatttccagagacaattccaagaacaccctgtatctgcacatgaacagcctgagagccgaggacacggccgtatatttctgtgcgaaagatctcggtatggcactagctggcaagcccgaacctttgactattgggccaac

SEQ ID NO: 786641 - DNA, 438 bp, Homo sapiens
  misc_feature: NA.21.14.B03.1.454.heavy.3.zerom50
ttgggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaagggcccatcggtcttccccctggcaccctcctccaagagcacctctgggggcacagcggccctgggctgcctggtcaaggactacttcccgagcgacga

SEQ ID NO: 786642 - DNA, 470 bp, Homo sapiens
  misc_feature: NA.53.32.C10.1.454.heavy.3.zerom50
ctgggagaggagcccagcactgggattccgaggtgtttccattcagtgatctgcactgaacacagaggactcgccatggagtttgggctgagctgggttttccttgttgctattttaaaaggtgtccagtgtgaagttcacctggtggagtccgggggaggcttggtccggcctgggggttccctgagactctcctgtggagcctctaggttcaccttcagtagtaatcacatgacctgggtccgccaggctccagggaaggggctggattgggtctcagttatttatagcactggtacgacatactacgcagactccgtgagggggccgatttaccatcctccagagacaactccaagagcacgttgtatcttcagatgaacagcctgagacctgcggacacggctgtctattactgtgcgaccgaaacacgtggatatagtggctacgattttggctttcggcctggt

SEQ ID NO: 786643 - DNA, 474 bp, Homo sapiens
  misc_feature: NA.52.40.D07.1.454.heavy.3.zerom50
taacaacagagggacagggtctgtgaagccttcacagaccctgtccctcacctgcactgtctctggtggctccatcaacagtggtagtttcttctggacctggatccggcagcccgccgggaagggactggagtggattgggcgtatccataccagtggcatcaccgagtacaccccttccctcaagagtcgactctccatatcactagacgcgtccaagaaccaggtcttcctgatggtgagctctgtgaccgccgcagactcggccagatattactgtgcgagagcgggggcggctaatgtcgcaggctattacttcggtttggacgtctggggccaagggaccacggtcaccgtctccgcagcctccaccaagggcccatcggtcttccccctggcaccctcctccaagagcacctctgggggcacagcggccctgggctgcctggtcaaggactacttcctatacgatcg

SEQ ID NO: 786644 - DNA, 433 bp, Homo sapiens
  misc_feature: NA.52.32.C10.1.454.heavy.3.zerom50
ctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttaac

SEQ ID NO: 786645 - DNA, 487 bp, Homo sapiens
  misc_feature: NA.4.71.G05.1.454.heavy.3.zerom50
aggaagaccgatgggcccttggtggaggcttggtgaagccggggggtcccgttagactctcctgtgcagtctctggactcaacctcaaaatagcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagccggccctgggctgccctggtccaaggactactttccctac

SEQ ID NO: 786646 - DNA, 351 bp, Homo sapiens
  misc_feature: NA.48.58.F03.1.454.heavy.3.zerom50
aagggaaaggggctggacgggatctcgggaattagtgctgctagtggtagcagtttatacgcagactccgtgaagggccgattcaccatctccagagacaattccaagaacacggcgtatctgcagatgaacaacctgggcgtcgaggacacggccatttattactgtgcgaaatcctctggccgtgccgctaggtactttgagcactggggtccgggaaccctggtcaccgtctcctcagcctccaccaagggcccatcggtcttccccctggcgccctgctccaggagcacctccggagagcacagcggccctgggctgcctggtcaaggactacttcctatgtatact

SEQ ID NO: 786647 - DNA, 476 bp, Homo sapiens
  misc_feature: NA.16.33.C11.1.454.heavy.3.zerom50
ttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctgggggccaac

SEQ ID NO: 786648 - DNA, 508 bp, Homo sapiens
  misc_feature: NA.22.82.H05.1.454.heavy.3.zerom50
tctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagccgacgacacggccatttattactgcgcgaaggatatacgggtcgacaacggtggctacgcgtttctagtcgtaacggggtcggtaccgttaccggttccgtttaccgtaagt

SEQ ID NO: 786649 - DNA, 356 bp, Homo sapiens
  misc_feature: NA.13.60.F05.1.454.heavy.3.zerom50
gggaaaggggctggagtggattggccgtattaaaagtgagcctgatggtgggacaacagactacgctgcacccgtgaagggcagattcaccatctccagagatgattcaaggaacacagtgtttctgcaaatgaacagcctgactgccggggacactgccgtgtattactgtgccagcagcagtacctggccactatatttttttgacttctggggccagggaaccctggccaccgtctcctcagcttccaccaagggcccatcggtcttccccctggcgccctgctccaggagcacctctgggggcacagcggccctgggctgcctggtcaaggactacttcctagtackwgacg

SEQ ID NO: 786650 - DNA, 468 bp, Homo sapiens
  misc_feature: NA.2.49.E05.1.454.heavy.3.zerom50
aacacacaaagggggccccagccctgggattcccagctgtttctgcttgctgatcaggactgcacacagagaactcaccatggagtttgggctgagctgggttttccttgttgctattttaaaaggtgtccagtgcgaggtgctgctggtggagtccgggggaggcttagttcagcctggggggtccctgagactctcctgtgcagcctctggattcaccttcagtcgctactggatgcactggttccgccaagttccagggaaggggctggagtgggtctcacgcattgatccatctgggaataggattaactacgcggcctccgtgaggggccgattcaccatctccagagacaacgccaggaacactctgtatctggaaatgagcagtctcagaggcgaggacacggctgtttattactgcacaagtgacgcgttcggggagactgactacgtggggccaggggc

SEQ ID NO: 786651 - DNA, 494 bp, Homo sapiens
  misc_feature: NA.40.79.H02.1.454.heavy.3.zerom50
agggaaagggggctttctgagagtcagggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggttggatccgccagcccccagggaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacgggtgccccgaagaaaaagtgttttaatcccgtggggccgagggaaccctggtcaccgtctccctcagcctccaccaacgggcccatccttcc

SEQ ID NO: 786652 - DNA, 475 bp, Homo sapiens
  misc_feature: NA.4.27.C05.1.454.heavy.3.zerom50
agggtttgggcacgaccggtgctcgatttagacgcgatcgaagggtttgggggggagaggagcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagcctggggggtccctgagactctcctgtgcagcctctgggttcaccgtcacttacagccacatgagttgggtccgccaggctccagggaaggggctggagtgggtctcaggttctcataacgatggtactacatcgtactcagactccgtgaagggccgattcaccatctccagagacaattccaagaacatggttatcttcaaatgaatagactgcgggcgaggacacggccgtctactactgtgcggaggggg

SEQ ID NO: 786653 - DNA, 478 bp, Homo sapiens
  misc_feature: NA.15.73.G07.1.454.heavy.3.zerom50
agggtcttcgtggctcacgtccaccaccacgcatgtgacctcaggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagatttttggagtggttattatacctttgactcttggggccagggaaccctggtcaccgtctcctcagcctccaccaagggcccatcggtcttcccctggcaccctcctccaagagcacctctgggggcacagcgrccctgggctgcctggtcaaggactacttccgctacgtacgtacg

SEQ ID NO: 786654 - DNA, 492 bp, Homo sapiens
  misc_feature: NA.13.27.C05.1.454.heavy.3.zerom50
agggtttggggagggaagtgctttctgagagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtggatccggcagcccccggggaaggagctggagtggatggggaggatttattatactggcaatacttacgacaatccgtccctcaagagtcgagtcaccctgtccgtggacacgccgaataaccagttctccctgaaagtgacctctgtgaccgtcgcagacacggccatttattattgtgtgagatacgacttttggaatggctatgactcgatcgactacgtggggccctggaatcctggtcaccgtctcctcagcctccaccaaggg

SEQ ID NO: 786655 - DNA, 457 bp, Homo sapiens
  misc_feature: NA.8.59.F04.1.454.heavy.3.zerom50
tagggattgggggagcatcacccagcaaccacatctgtcctctagagaatcccctgagagctccgttcctcaccatggactggacctggaggatcctcttcttggtggcagcagccgcgggagtccactcccaggtgcaactggtgcagtctggggctgaagtgcgcgagcctggggcctcagtcagagtctcctgcaaggcttctggatacgccttcggcgaccactatatacactggatgcgccaggcccctggacaagggcttgagtggatggcctggatctacccgaatagtggtggcacaaattatgcacgggagtttcagggcagggtcaccgtgaccagggacacgtccatcactacagtctatatgcatttgagcggcctcagatctgacgacacggccgtctacttttgtgcgagggaccgaccgtcttttgactggacgactcacta

SEQ ID NO: 786656 - DNA, 439 bp, Homo sapiens
  misc_feature: NA.15.38.D05.1.454.heavy.3.zerom50
ttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgagaacccgtagagatgggtacaaaagggaggggacttactttgactactggggccggggaaccctggtcaccgtctcctcagcctccaccaagggcccatcggtcttccccctggcaccctcctccaagagcacctctgggggcacagcggccctgggctgcctggtcaaggactacttccgctacgtaga

SEQ ID NO: 786657 - DNA, 354 bp, Homo sapiens
  misc_feature: NA.26.60.F05.1.454.heavy.3.zerom50
gggaaaggggctggcgtgggtctcaagtattgatgagaatggtggaagcacattctacgtagactccgtgaagggccgcttcaccatctccagagacaatttcaggagcacgctgtttctgcaaatgaacagcctgagagccgaggacacggccctctatttctgtgcgaaagtctatagcagtgccccctacgcgcacttctttgacttctggggcaagggaatcctggtcaccgtctcctcagcctccaccaagggcccatcggtcttccccctggcgccctgctccaggagcacctccgagagcacagcggccctgggctgcctggtcaaggactacttccagtatagtct

SEQ ID NO: 786658 - DNA, 464 bp, Homo sapiens
  misc_feature: NA.11.19.B08.1.454.heavy.3.zerom50
aggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccagggaaggggctggagtgggtttcatacatttctagtaattctggtaccatacactatgcagtctctgtgaagggccgattcaccatctccagagacaacgccaggaactcactttatctgcaaatgagcagcctgagagtcgaggacacgggtatttattactgtgcgagagatagtctgtctatgcttccgggagctaactaa

SEQ ID NO: 786659 - DNA, 481 bp, Homo sapiens
  misc_feature: NA.18.6.A06.1.454.heavy.3.zerom50
aacgwacasacaaggggctgggagaggacgcccaggccactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcagtttacttgaccctggggccgggracccgtggtcaccgt

SEQ ID NO: 786660 - DNA, 479 bp, Homo sapiens
  misc_feature: NA.17.12.B01.1.454.heavy.3.zerom50
ctgggtttrgggwytsrrsaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatcccggtgacgccgtacggcagcggtcctttgactttctggggccagggacg

SEQ ID NO: 786661 - DNA, 351 bp, Homo sapiens
  misc_feature: NA.4.42.D09.1.454.heavy.3.zerom50
agggaaaggggctggaatgggtggcaattgtctcctatgatggaagtaaaaatattatgcagactccgtgaagggccggtttatcatctccagagacaattacagggataccctatctttgcaaatgaataacgtgacagatgacgacacggctgtctactactgtgcgaggagccgttggtttgactatgataatggcatggatgtctggggccaagggaccacggtcaccgtgtcttcagcctccaccaagggcccatcggtcttccccctggcaccctcctccaagagcacctctgggggcacagcggccctgggctgcctggtcaaggactacttccctacagtgct

SEQ ID NO: 786662 - DNA, 441 bp, Homo sapiens
  misc_feature: NA.49.48.E04.1.454.heavy.3.zerom50
catcatccaacaaccacatcccttctctacagaagcctctgagagggaagttcttcaccatggactggacctggagggtcttctgcttgctggctgtagctccgggtgctcactcccaggtgcagttggtgcagtctggggctgaggtgaagaagtctggggcctcagtgaagatttcctgcaaggcttctggataccccttcaccatctaccacatgcactgggtgcgacaggccccgggacaagggcttgagtggatgggaataatcaaccctagtggtggtagcacaacctccgcacagaggttccagggcagagtcaccatgaccagggacacgtccacgagcacattctacatggaactgagccgcctgagatctgacgacacggccgtgtactactgtgcgagagtcactcattactacgatagttatggtgtmg

SEQ ID NO: 786663 - DNA, 336 bp, Homo sapiens
  misc_feature: NA.27.46.E02.1.454.heavy.3.zerom50
actggaatttgtttcagctgttagtcctaatgggggtaacacatattacggagactccgtgaagggcagattcaccatctccagagacaattccaacaatacgttgtatcttcaaatgagcagtctgagagctgaggacacggctacattttattgtgtgaaagtccaagggccggaatactactttgactactggggccagggaaccctggtcaccgtctcctcagcttccaccaagggcccatccgtcttccccctggcgccctgctccaggagcacctccgagagcacagccgccctgggctgcctggtcaaggactacttccagacgacgct

SEQ ID NO: 786664 - DNA, 377 bp, Homo sapiens
  misc_feature: NA.2.46.E02.1.454.heavy.3.zerom50
ctggagtggattggggaaatcaatcattttcgaggcaccacttacaacccgtccctcaagagtcgagtcaccattgcagtggacaggtccaagaaccagttttccctgaacttgaactctgtgaccgccgcggacacggctgtgtattactgtgcgagaggcgaattacccggtactgcgacacaccaagatcagctggtccgaaggctacttcgttactacggcatggacgtctggggccaagggaccacggtcaccgtctcctcagcctccaccaagggcccatcggtcttccccctggcaccctcctccaagagcacctctgggggcacagcggccctgggctgcctggtcaaggactacttcctgtcgagcgt

SEQ ID NO: 786665 - DNA, 355 bp, Homo sapiens
  misc_feature: NA.47.42.D09.1.454.heavy.3.zerom50
agggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 786666 - DNA, 447 bp, Homo sapiens
  misc_feature: NA.53.50.E06.1.454.heavy.3.zerom50
tctgggagaggagcccagcactagaagtcggcggtgtttccattcggtgatcagcactgaacacagaggactcaccatggagtttgggctgagctgggtcttcctcgttgctcttttaagaggtgtccagtgccaggtgcagttggtggagtctgggggaggcgtggtccagcctgggcggtccctgagactctcctgtgcagcctctggattcaccttcagagtctatggcatgaactgggtccgccaggctccaggcaaggggctggagtgggtggcacttatactagatgatggaagtaataaatattatgcagactccgtgaagggccgattcaccatctccagagacaattccaagaacactctgtatctgcaaatgaacagcctgagacctgaggacacggctgtctactactgtgcgaaacggtctgagtgggaggttta

SEQ ID NO: 786667 - DNA, 483 bp, Homo sapiens
  misc_feature: NA.40.3.A03.1.454.heavy.3.zerom50
aggggatgctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactactggggctggatccgccagtccccagggaaggggctggagtggattggaattatctattatagcgggagcacctactataatccgtccctcaagagtcgagtcaccatatccgtagacacatccaagaaccagttctccctgaggctgagccctgtgaccgccgcagacacggctgtctattactgtgcgacccatcgatatcatgactggttgttagggcacgtctggggccaagggaccacggtcaccgtcctcctcacgcctccaccaacggggccc

SEQ ID NO: 786668 - DNA, 441 bp, Homo sapiens
  misc_feature: NA.10.84.H07.1.454.heavy.3.zerom50
aggagcatcacccagcaaccacatctgtcctctcgagaatcccctgagagctccgttcctcaccatggactggacctggaggatcctcttcttggtggcagcagccacaggagcccactcccaggtgcacctggtgcagtcggggactgcagtgaggacgcctggggcctcagtgaaggtctcctgcaaggcttctggatacaccttcaccagcttctatatacactgggtgcgacaggcccctggacaaggacttgagtggatgggctggatcaaccctggaagcggtggcacaaattatgcacagagctttcagggcagggtcaccgtgaccagggacacgtccatcgacacagcctacatggacctgagcagtctgaagtctgacgacacggccgtctattactgtgcgagggcgggaggaccttatcagtggtaacc

SEQ ID NO: 786669 - DNA, 498 bp, Homo sapiens
  misc_feature: NA.13.64.F09.1.454.heavy.3.zerom50
agggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtggatccggcagcccccggggaaggagctggagtggatggggaggatttattatactggcaatacttacgacaatccgtccctcaagagtcgagtcaccctgtccgtggacacgccgaataaccagttctccctgaaagtgacctctgtgaccgtcgcagacacggccatttattattgtgtgagatacgacttttggaatggctatgactcgatcgactactggggccctggaatcctggtcaccgtctcctcagcctccaccaagggcccatcggtcttccccctggccacccttcg

SEQ ID NO: 786670 - DNA, 351 bp, Homo sapiens
  misc_feature: NA.12.22.B11.1.454.heavy.3.zerom50
agggaaggccctggagtggataggatacatctctaaaagtgggagyaccttctacaatccgtcactcaagagtcgagtttccatatccgtagacatgaccaagaatcacttctccctgaacctgacctctatgactgtcgcagacacggccgtctattactgtggcagagaaagatatatagcggcggtccatctatacatagacgtctggggcaaagggaccacggtcaccgtctcctcagcctccaccaagggcccatcggtcttccccctggcaccctcctccaagagcacctctgggggcacagcggccctgggctgcctggtcaaggactacttcctacgtcgtat

SEQ ID NO: 786671 - DNA, 465 bp, Homo sapiens
  misc_feature: NA.15.30.C08.1.454.heavy.3.zerom50
aagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtctgggggacgcctggtcaagcctggggggtccctgagactctcctgtacagtctctggattcaccttcagtagttatggcatgaactgggtccgccaggctccagggagggggctggagtgggtctcatccattagtgctggaagtagttacatctactacgcagactcagtgaggggccgattcaccatctccagagacaacgccagggactcagtgtatctgcaaatgaacagcctgagagccgaggacacggctgtgtattactgtgcgagagatctaggggcctacccggagatggctac

SEQ ID NO: 786672 - DNA, 446 bp, Homo sapiens
  misc_feature: NA.53.26.C04.1.454.heavy.3.zerom50
aagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgacatctgacgacacggccgtttattattgtgtgagagaggacccgatcgacctcggtmcg

SEQ ID NO: 786673 - DNA, 350 bp, Homo sapiens
  misc_feature: NA.12.24.C02.1.454.heavy.3.zerom50
tagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcggtcttccccctggcgccctgctccaggagcacctccgagagcacagcggccctgggctgcctggtcaaggactacttcctacgtcgtat

SEQ ID NO: 786674 - DNA, 545 bp, Homo sapiens
  misc_feature: NA.19.2.A02.1.454.heavy.3.zerom50
agggggctttctgagagtcatggacctcctgcacaagaacatgaaacacctgtggttcttcctcctcctggtggcagctcccagatgggtcctgtcccaggtgcagctacagcagtggggcgcaggactgttaaagccttcggagaccctgtccctcacctgcgctgtctatggtgggtccttcagaggttactactggagttggatccgccagcccccagggaagggactggagtggattggggaaatcaatcatagtggaagcgccagctacaacccgtccctcaagagtcggctcgacatattagtagacacgcccaagagtcagttctccctgaagctgggctctgtgaccgccgccgacacggctgtctatttctgtgcgagagttggatattgtgctggtggtagctgctacgccgcgtttcagttagactactggggtcagggaaccctggtcaccgtctcctcacgcctccaccaagggcccatcggtcttcccctggcgccctgctccaggagcacctccgagagcacagcgcctc

SEQ ID NO: 786675 - DNA, 493 bp, Homo sapiens
  misc_feature: NA.40.82.H05.1.454.heavy.3.zerom50
cacgaccggtgctcgatttagtagtgtagattcgcggggccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactggacctcgtgacgacacggccatgtattactgtggaagagacgttggtggctaccgcggggctgaccacgtc

SEQ ID NO: 786676 - DNA, 462 bp, Homo sapiens
  misc_feature: NA.52.79.H02.1.454.heavy.3.zerom50
agggaaagggggggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtcccygagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttctttctacaaatgaaacagcctgagagctgaggacacggctatgttttactgtgcgagagggaactcgattacagcagccctgaa

SEQ ID NO: 786677 - DNA, 402 bp, Homo sapiens
  misc_feature: NA.10.11.A11.1.454.heavy.3.zerom50
agggtgtacacctgtggttctcggggccgccggaaagggcccggagtggcttggtcggatctctctcactgggaacaccctatacaacccctctttcatgggtcgactctccctttcactggacctgtctgagaaccagttctccatgacactgacctctgtcatcgccgctgacacggccgtctatttctgcgcgtcctcatcccttattcatcatgatggttctacttattattacgagagatctgagtttgaccactggggccagggcatgctagtcaccgtctccccagcctccaccaagggcccatcggtcttccccctggcaccctcctccaagagcacctctgggggcacagcggccctgggctgcctggtcaaggactacttcccactactatg

SEQ ID NO: 786678 - DNA, 494 bp, Homo sapiens
  misc_feature: NA.46.9.A09.1.454.heavy.3.zerom50
agggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggaggcgtagtccagcctggggaggtcacagagactctcctgtgcagactctgggttcaccttcagtagctacggcatgcactgggtccgccaaactccaggcaagggattggagtgggtggcagtttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaagggaggggggaaccgaggcgggagttccgaagttacctccttttgaccgtcgtgggggccgtac

SEQ ID NO: 786679 - DNA, 436 bp, Homo sapiens
  misc_feature: NA.48.54.E10.1.454.heavy.3.zerom50
aacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcagggcagggtcaccatgaccagggacacgtccatcaagcacagcctacatggaattgagcaggctgacatctgacgacacggccgtgtattattgtgtcgagagcccktc

SEQ ID NO: 786680 - DNA, 468 bp, Homo sapiens
  misc_feature: NA.14.71.G05.1.454.heavy.3.zerom50
agcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagatttttggagttggttattatacctttgacttcgttcgggggccg

SEQ ID NO: 786681 - DNA, 364 bp, Homo sapiens
  misc_feature: NA.14.42.D09.1.454.heavy.3.zerom50
agggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaaccctggtcaccgtctcctcagcctccaccaagggcccatcggtcttccccctggcaccctcctccaagagcacctctgggggcacagcggccctgggctgcctggtcaaggactacttccgtactagacg

SEQ ID NO: 786682 - DNA, 467 bp, Homo sapiens
  misc_feature: NA.14.87.H10.1.454.heavy.3.zerom50
ttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctgggagtgggtctcaggtattagwtggaatagtggtagcataggctatgcggactctgtgaagggccgagttcaccatctccagagacaacgccaagaactccctgtatctgcaaatgaacagcctgagagctgaggacacggccttgtattatttgtgacaaaagataccaaccccttaacgtt

SEQ ID NO: 786683 - DNA, 467 bp, Homo sapiens
  misc_feature: NA.5.6.A06.1.454.heavy.3.zerom50
aggggtctcagagaggtgccttagccctggattccaaggcatttccacttggtgatcagcactgaacacagaggactcaccatggagttggggctgcgctgggttttccttgttgctattttagaaggtgtccagtgtgaggtgcagctggtggagtctgggggaaagttggtgcagcctggggagtccctgagactctcctgtgaaggcgctggatttaccctcagttcctataaaatgggctgggtccgccaggctccagggaaggggctggagtggctttcaatcatctacagtagtgggagtgtcatttattacgcggactctgtgaagggccgattcaccatttccagagacaacgccaagaactcactgtatctgcaaatgaacagcctgagagccgaggacacggctgtatattactgtgcgagagatctgggggccaacagttggccctactttgtacg

SEQ ID NO: 786684 - DNA, 471 bp, Homo sapiens
  misc_feature: NA.16.15.B04.1.454.heavy.3.zerom50
tccgcggggagctctgagagaggagcccagccctgggattttcaggtgttttcatttggtgatcagggctgaacagagagaactcaccatggagtttgggctgagctggctttttcttgtggctattttaaaaggtgtccagtgtgaggtgcagctgttggagtctgggggaggcttggtacagcctggggggtccctgagactctcctgtgcagcctctggattcatctttagcagctatgtcatgacctgggtccgccaggctccagggaaggggctggagtgggtctcagttattggtggtagtggttataccacatactacgcagactccgtgaagggccggttcaccatctccagagacaattccaagaacacactatatctgcaaatgaacagcctgagagccgaggacacggccgtatattactgtgcgaaaggccagggtatagcagtggctggtacctaacg

SEQ ID NO: 786685 - DNA, 470 bp, Homo sapiens
  misc_feature: NA.5.20.B09.1.454.heavy.3.zerom50
aggggagctctgggagacgagcccagcactggaagtcgccggtgtttccattcggtgatcatcactgaacacagaggactcaccatggagtttgggctgaactgggttttcctcgttgctcttttaagaggtgtccactgtcaggtgcaactggtggagtctgggggaggcgtggtccagcctggaacgtccctgagactctcctgtgcagcctctgggttcacctacaataaatatgctatgcactgggcccgccaggctccaggcaaggggctggagtgggtggcagttatctcagacgatgaaagtcataaatactacacagactccgtgaagggccgattcaccatctccagagacaattaccaaaaagatgttatatctgcaaatgaacagcctgagacctgaggacacggctgtatattattgtgtgacggggactcaactcgtgggggacccacgtttgaacg

SEQ ID NO: 786686 - DNA, 350 bp, Homo sapiens; identical to SEQ ID NO: 786262
  misc_feature: NA.40.30.C08.1.454.heavy.3.zerom50

SEQ ID NO: 786687 - DNA, 465 bp, Homo sapiens
  misc_feature: NA.52.72.G06.1.454.heavy.3.zerom50
tctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctggggggggcgtggtccagcctgggaggtccctgagactctcctgtgcaggctctgcatttcccttcagtaactatgctatcgattgggtccgccaggctccaggcaagggactggagtgggtggcagttatatcagctgatggaggcagtaaatattacgcagattctgcgagggccgattcaccatatccagagacaactcccaagatatgatatatctacaaatgaacagcctgagacctgaggacacggctgtatattattgtgcgtcrggggcaggtgcctggccacggtaggtcctcgggcctacc

SEQ ID NO: 786688 - DNA, 487 bp, Homo sapiens
  misc_feature: NA.53.17.B06.1.454.heavy.3.zerom50
agggggctctgggagaggagcccagcactagaagtcggcggtttttccattcggtgatcagcactgaacacagaggactcaccatggactgttaagaggtgtgtcgagcactgggtccgccaggctccaggcaaggggctgaagtgactgccacttaacatcagatgatcgaatcaataggttttatgcggactcggtgaggggccgattcaccgtctccggagacaattccaagaatacgagataggtgcaaatgaagaccctgggacttgaagacacgggtgcgtcttcctgtgcgactgtgtcccaacgttgtattctttgagtggacgtctcgagaacaagggaccacggtcatcgtctcctccgatgagactgaccactctggggcctttgatttccgccactgcctgtggaatttccgcactagtggagcctccaccaagggcccatccggtcttccccctggccaccctcctccaagacg

SEQ ID NO: 786689 - DNA, 467 bp, Homo sapiens
  misc_feature: NA.48.18.B07.1.454.heavy.3.zerom50
agggggagagaggagccttagccctggattccaaggcctatccacttggtgaccagcactgagcaccgagggttcaccatggaattggggctccgctgggttttcctggttgctgttttagcaggtggcagtgtgacgtgcacctgctggagtcggggggaggcctggtcaagcggggggggtccctgagactctcttgtgaagcctctaaaatcagtctcgagagttccagcatgaactgggtccgccaggctccagggaagggcctggagtgggtctcatccatcagcagtggaggcaaccatatgttgtatgccgactcagtgaggggccgattcagcgtctccagagacaacgccaagatgtcagtatatctggaaatgaacaacctaagagtcgaggacacggctgtctactactgtgcgagagatgtgattccagtgacttggtgggtggtactttgactt

SEQ ID NO: 786690 - DNA, 472 bp, Homo sapiens
  misc_feature: NA.13.25.C03.1.454.heavy.3.zerom50
aagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctgaggcctcagtgaaggtctcctgcaaggcttccggatacaccctcaatggaaactatgtccactatgtgcgacaggccccaggacaagggcttctgtggatggggtggatcaaccctaatagtggtgacacaaactatgagaagaaatttgagggccgggtcaccatgaccagggacacgtccatcaatacagccttcatggaactgaccagactgacctctgacgacacggccgtgtattactgtgcggtcgaaactcagcctaactactttgtaattttggggccagggagccctggtcaccgtcctcc

SEQ ID NO: 786691 - DNA, 481 bp, Homo sapiens
  misc_feature: NA.21.76.G10.1.454.heavy.3.zerom50
aggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctggggggtccctgagactctcctgtgcggtctctgggttcaccgtcactactaactccatgagctgggtccgccaggctccagggaaggggctggagtgggtctcagttatttatagtggtggtggtgcagattacgcagactccgtgaagggccgattcaccatctccagagacaattccatgaacacgctgtatcttcaaatgaacagcctgagagccgacgacacggccgtctattactgtgcgacgggagtgacgggaggagggcagtggatactttgaccacgtggggggacgtaacc

SEQ ID NO: 786692 - DNA, 338 bp, Homo sapiens
  misc_feature: NA.40.13.B02.1.454.heavy.3.zerom50
ttggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttccagtcgctaga

SEQ ID NO: 786693 - DNA, 476 bp, Homo sapiens
  misc_feature: NA.51.65.F10.1.454.heavy.3.zerom50
aagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaaggggactgacatctgacgacacggccatgtattattgtgcgagagaaatgttaggtactgctttgggtccctggggcccgggaacccgggtcgacgtccgg

SEQ ID NO: 786694 - DNA, 465 bp, Homo sapiens
  misc_feature: NA.22.5.A05.1.454.heavy.3.zerom50
aagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaaggccctagactggcttgcactcatttattggaatgatgataagcgctacagcccatctctgaagagcagactcaacatcaccaaggacacctccaaaaagcaagtggtccttacaatgaccaacatggaccctttggacacagccacatattactgtgcacaccacagggtctctactgctggctttcagtacaactggttcgaaccctggggccagggaaccctggtcagcgtctcctcagcctcccscg

SEQ ID NO: 786695 - DNA, 469 bp, Homo sapiens
  misc_feature: NA.21.15.B04.1.454.heavy.3.zerom50
tccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccagccgggggggtccctgagactgtcctgtgaagtctctggattgtatagcagagattggatgcactgggtccgccagacttcaggaaagggtctggagtgggtggccaacataaaccaagatggaagtgtgaagcactatgtggcctctgtgaggggccgattcacaatctccagagacagtgccaagaactcgttgtatctgcaaatggacagcctgagagccgaggacacggctctctattactgtgcgaccggatatggctacgtcattgcgtccgtggggcccg

SEQ ID NO: 786696 - DNA, 460 bp, Homo sapiens
  misc_feature: NA.51.51.E07.1.454.heavy.3.zerom50
ctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttgtatcaaatgatggaaataagaaatactatatagactccgtgaggggccgattcgccatctccagagacaattccaagaacacactgtatctgcacatgaacagcctgagagccgaaagacacgggtgtttactactgtgcgaacttaattacggtaggaccgaacgggtaacccccg

SEQ ID NO: 786697 - DNA, 460 bp, Homo sapiens
  misc_feature: NA.40.1.A01.1.454.heavy.3.zerom50
aggggagctctgggagacgagcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcattttcagtaactatgctatgcactgggtccgccagactccgggcaaggggctggagtgggtggcaattatctcatatgatgaaagtcaagaatactacgcagactccgtgaagggccgattcaccatctccagagacaattccaagaacacactgaatctacaaatgaacagcctcagacctgaggactcggctgtctatttctgtgcgaggagggggtgactatcgattcctttgt

SEQ ID NO: 786698 - DNA, 357 bp, Homo sapiens
  misc_feature: NA.18.1.A01.1.454.heavy.3.zerom50
gaaggaagggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctgggggcacagcggccctgggctgcctggtcaaggactacttcccatactcgta

SEQ ID NO: 786699 - DNA, 488 bp, Homo sapiens
  misc_feature: NA.41.34.D01.1.454.heavy.3.zerom50
ttgggtttgggcacgaccggtgctcgatttagatcggctgagctgggttttccttgttgttattttacaaggtgtccagtgtgaggtgcagctggtggcgtctgggggaggcttggtccagcctggagggtccctgagactctcctgtgtagcctctggattcacactcagtgaccactgcatggactgggtccgccaggctccagggaaggggctggagtgggttggccgttctagaagcaaacgtgagagttacaccacagagtaccgcgcgtctgtcagaggcagattcaccatctcaagagatgattcaaggaactcattgtatctgcaaatggacaccctggaaaccggggacacgggcgtgtattactgtgctagaggtcgttgggggtgacggctcgcccatggcgcactactggggccaggkaaccctggtcaccgtctcctcagccgtccaccaacgggcccatcggtccttccccctc

SEQ ID NO: 786700 - DNA, 381 bp, Homo sapiens
  misc_feature: NA.26.86.H09.1.454.heavy.3.zerom50
ttgggtccgccagccccccgggaagggactggagtggattggggaagtctttcatactgggacccccgactacaacccgtccctcgagggtcgagtcgtcatatcgttagacaagtccaagaaccagttctccctgaggctgacttccgtgaccgccgcggacacggccgtctattactgtgcgagggtggtcggggacttcgaagatatggactatttgtattactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccagtatagtct

SEQ ID NO: 786701 - DNA, 457 bp, Homo sapiens
  misc_feature: NA.51.3.A03.1.454.heavy.3.zerom50
aggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaagctttgagtggatgggatggatcaccgctggcaatggtgacacaaaatattcacagaagttccagggcagagtcaccattaacagggacacatctgcgagtacaggctacatggaactgagcggcctgagatctgaggacacggctatttattactgtgcgagagggaagtgggatattgtggcagctccaggtgcccagcccggccccttacg

SEQ ID NO: 786702 - DNA, 483 bp, Homo sapiens
  misc_feature: NA.51.17.B06.1.454.heavy.3.zerom50
aggggcagtgactcctgtgccccaccatggacacactttgctccacgctcctgctgctgaccatcccttcatgggtcttgtcccagatcaccttgaaggagtctggtcctacactggtgaaacccacacagaccctctcgctgacctgcgccttctctgggttctcactcagcagtagtggagtgggtgtgggctggatccgtcagcccccaggaaaggccctggagtgggttgcactcatttattggaatgatgaaagccgctacagcccatctctgaagagcaggctcaccatctcgaggggcaggtccgaaaaccaggtgatccttacgatgagtaacttggaccctgtggacacagccacatattactgtgcacacaggttcggcgtatttttggagttggttattcaaacccctacttcgacttctggggcccgggaatcctggtcaccgtctcctcagcctccaccaacccgaaacc

SEQ ID NO: 786703 - DNA, 506 bp, Homo sapiens
  misc_feature: NA.40.45.E01.1.454.heavy.3.zerom50
ctttctgagagtcttggatctcatgtgcaagaaaatgaagcacctgtggttcttcctcctgctggtggcggctcccagatgggtcctgtccctgatgcaggtgcgggagtcgggcccaggactggtgaagccttcggggaccctgtccctcaactgctttgtctctggcaccaccatcaggggtagcagtttctattgggcctgggtccgccaggccccaggcaaggggctggagtggattgggaatgtccatgctcttgggcgctcctactacaacccggccctcaagagtcgagtcctcatttccatagacacggccaacaaccagttttccctgacgctgaggtctgtgaccgccgcagacacggctttatattactgtgcgagactcggcttttgtagtggtggtagctgcaatccgggttactactccaacttcggtttggacatctggggccaaggggacctcggtcgtcgtttcctcagcctccaccaagggcccatcc

SEQ ID NO: 786704 - DNA, 410 bp, Homo sapiens
  misc_feature: NA.16.53.E09.1.454.heavy.3.zerom50
ttgggtttaggattcacgttgcagatttgggtttgggtgcgccagatgcccgggaaaggcctggagtggatggggaggattgaggctagtgactcttataccaactacagcccgtccttccaaggccacgtcaccatctcagttgacaagtccatcaacactgcccacctgcagtggagcagcctgaaggcctcggacaccgccatgtattactgtgcgagacatggggatttatattgtactaataatgtatgccactttgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 786705 - DNA, 473 bp, Homo sapiens
  misc_feature: NA.12.73.G07.1.454.heavy.3.zerom50
agggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtctgggggaggcctggtcaagcctgggggatccctgagactctcctgtgcagcctctggattcagcttcagtcactatagtatgaactgggtccgccagactcctgggaaggggctggagtgggtctcattcatcagtagtgccaacaattacatttactacgccgactcagtgaagggccggttcaccatctccagagacaacgccaatgactcactgaatctgcaactgaaaagcctgagagccgaggacacggcaatttatttctgtgcgagaagttttagaggaacgcagataaggagggggggcgagtggacgtc

SEQ ID NO: 786706 - DNA, 344 bp, Homo sapiens
  misc_feature: NA.18.61.F06.1.454.heavy.3.zerom50
ctggagtggttgagttttatatcatatgatggaggttacaaatattatgcagagtccgtgaagggccgattcatcatctccagagacaactccaagaacacactgtttctgcaagtggacagtctgagacctgaggacacggctgtatattactgtacgagagatccggggggtcacgaccactggaactactttaccttctggggccagggaaccctggtcatcgtctcctcagcctccaccaagggcccatcggtcttccccctggcgccctgctccaggagcacctccgagagcacagcggccctgggctgcctggtcaaggactacttcccatactcgta

SEQ ID NO: 786707 - DNA, 447 bp, Homo sapiens
  misc_feature: NA.14.81.H04.1.454.heavy.3.zerom50
agctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcggggggaggcgtggtccagcctgggaggtccctgagactctcctgtgcagcctctggattcaccgtcagtagttctggcatgcactgggtccgccaggctccaggcaaggggctgggattggggtgggagttatatcatatgatggaactaataaagactatgcagactccgtgaagggccgattcaccatctccagagacacttccaggaacacgctgtatctgcaaatgaacagcctgagagctgaggacacggcagtgtaattactgtgcgaaagatagggtcggtag

SEQ ID NO: 786708 - DNA, 474 bp, Homo sapiens
  misc_feature: NA.3.87.H10.1.454.heavy.3.zerom50
ttgggtttgggaggcctttgttggagaccttgcacttgtactccttgccgttcagccagtcctggtgcacaacggtgaggacgctgaccacacggaacgtgctgttgaactgctcctcccgtggctttgtcttggcattatgcacctccacgccgtccacgtaccagttgaactggacctcggggtcttcgtggctcacgtccaccaccacgcacgtgacctcaggggtccctcagactctcctgtgcagcctctggattcggctttagcgacaatgccatggcttgggtccgccaggctccagggaaggggctggagtgggtcgctggtattggtggtgatagtcgcagacactacacagtctccgtgaggggccggttcaccatctccagagacaattccaagaacacggtgtatctgcaaatggacagcctgagagccgaggacacggcctatttattactgtgcgaaagt

SEQ ID NO: 786709 - DNA, 454 bp, Homo sapiens
  misc_feature: NA.48.50.E06.1.454.heavy.3.zerom50
agagaggagccttagccctggattccaaggcccagccacttggtgatcagcactgagcaccgaggattcaccatggaactggggctccgctgggttttccttgttgctattttagaaggtgtccagtgtgaggtgcagttggtggaatctgggggaggcctggtcaagccgggggggtccctgagactctcttgtgcagcctctggattcaccttcagtagatatgtcatgatttgggtccgccaggctccagggaaggggctggagtgggtctcatccattagtagtaatagtgattacatatattatgcagaatcactgaagggccgattcaccatctccagagacaacgccaaagagtctctgtttctggacatgaccagcctgagagccsgaagacacggctacatattactgtgcgaaagtttcggtctggagtcgttggtattttgtt

SEQ ID NO: 786710 - DNA, 456 bp, Homo sapiens
  misc_feature: NA.52.82.H05.1.454.heavy.3.zerom50
agacgagcccagcactggaagtcgccggtgtttccattcggtgatcatcactgaacacagaggactcaccatggagtttgggctgagctgggttttcctcgttgctcttttaagaggtgtccagtgtcaggtacaactggtggagtctgggggaggcgtggtccagcctgggaggtccctgagactctcctgtgcagcctctggattcaccttcagtacctatagtatacactgggtccgccaggctcctggcaagggactggagtgggtggcatctatatcaaatgatggaaacaataaccattctacagactccgtaaagggccgattcaccatctccagagacaattccaagaacacggtgtctctacaaatgaacagtttgagacttgaggacacggctgtatattactgtgcgcgagggaattcgattatagcagccctcgaagaccatcr

SEQ ID NO: 786711 - DNA, 452 bp, Homo sapiens
  misc_feature: NA.53.87.H10.1.454.heavy.3.zerom50
ttgggtttgggggagcatcaccctgcaaccacagctgtcctctagagaayccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgacatctgacgacacggccgtttattattgtgtgagagaggacccgatgtacckc

SEQ ID NO: 786712 - DNA, 356 bp, Homo sapiens
  misc_feature: NA.47.2.A02.1.454.heavy.3.zerom50
agggkaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 786713 - DNA, 451 bp, Homo sapiens
  misc_feature: NA.40.48.E04.1.454.heavy.3.zerom50
agctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttgcagtcggggggaggcttggtacagcctggggggtccctgagactctcctgtgcagcctctggattcacctttacctcctattccatgagctgggtgcgccaggctccagggcagggcctggagtgggtctcaggcattagtagtaatggtgctgccacattctacgcagactccgtgaagggccggttcaccatctccagagacaattccaagaacacggtacatctgcaaatgaacagcctgacagccgaggacacggccgtttattactgtacgaaggatycgtccctgtctcggctg

SEQ ID NO: 786714 - DNA, 465 bp, Homo sapiens
  misc_feature: NA.40.39.D06.1.454.heavy.3.zerom50
cagttctttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgattgcctttgatatgtggggccgaagggacaagtggtacg

SEQ ID NO: 786715 - DNA, 473 bp, Homo sapiens
  misc_feature: NA.13.2.A02.1.454.heavy.3.zerom50
aggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggggcttggtccagcctggggggtccctgagactctcctgtgcagcctctggattcacttttagtaggtattggatgggttgggtccgccagactccagagaagggactgggagtgggtggccaacataaaggaagatggaagtgaaagatactatgtggactctgtgaagggccgattcaccatctccagagacaacgccaagaactcactgtatctgcagatgaccagcctgagagtcgaggagtacggctgtgttattattgtgcgagagakkggggcacgactattttggtagtaggtagtac

SEQ ID NO: 786716 - DNA, 451 bp, Homo sapiens
  misc_feature: NA.13.73.G07.1.454.heavy.3.zerom50
aggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaacttactactattacg

SEQ ID NO: 786717 - DNA, 436 bp, Homo sapiens
  misc_feature: NA.18.70.G04.1.454.heavy.3.zerom50
aagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggctgcctggtcaaggactacttcccatactcgta

SEQ ID NO: 786718 - DNA, 480 bp, Homo sapiens
  misc_feature: NA.40.43.D10.1.454.heavy.3.zerom50
agggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggagtctgggggaggcttggcacagcctggggggtcccggagactctcctgtgcagcctctggattcgcctttcagaactctgccatgcactgggtccgccagcctccagggaaggggctggagtgggtctcaggtattcggggtgatggtactgacacatactacgcagactctgcgaagggccggttcaccatctccagagacatttccaagaacacactctatctgcaaatgaccaacctcagaggcgaggacacggccatatattactgtgcgaaaggtggtgactatgaccactggggccaggggaacccctggtcaccgg

SEQ ID NO: 786719 - DNA, 613 bp, Homo sapiens
  misc_feature: NA.17.16.B05.1.454.heavy.3.zerom50
gttggggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccagggagccctggtcaccgtctcctcagcctccaccaagggcccatccgtcttcccctggcgccctgctccaggagcacctccgagagcacagcggccctgggctgcctggtcaaggactacttccctagtctacg

SEQ ID NO: 786720 - DNA, 456 bp, Homo sapiens
  misc_feature: NA.53.7.A07.1.454.heavy.3.zerom50
aggggagctctgagagaggagccttagccctggactccagggcctatccacttggtgatcaacactgagcaccgaggattcaccatggaactggggctccgctgggttctccttgtcgctattttagaaggtgcccagtgtgaggtgcaattggtggagtctgggggaggcctggtcaggcctggggggtccctgaggctctcctgttcagactctacattcaatgtcagtgacgataatatgtactgggtccgccaggctcctggacaggggctggaatgggtcgcattccttagtcgaagtgatggttccacattctacgcagactcaatgcggggccgattcatcatctccagagacaccgccaagaacacactctttctgcagatgaacagtctgagggccgaagacacggctgtctactattgtgtgcgagagattttctggtttggcggc

SEQ ID NO: 786721 - DNA, 484 bp, Homo sapiens
  misc_feature: NA.2.40.D07.1.454.heavy.3.zerom50
taacaacagagggggggaagtgctttctgagagtcatggacctcctgcacaagaacatgaaacacctgtggttcttcctcctcctggtggcagctcccagatgggtcctgtccctggtgcaactacagcagtggggcgcaggactgttgaagccttcggagaccctgtccctcacctgcgctctctatggtgggtccttcagtaataactactggaactggatccgccagtccccagggaaggggctggagtggattggggagatcaatcaaactggaagcaccaaccacaacccgtccctggagagtcgagtcaccatatcactagacacgtccacgaaccagttctccctgaatgtgagctctgtgaccgccgcggacacggctgtatattactgtgcgagaggccgaaggtatgttgtatcactggctgggaccactaagagttaactactacatggacgtcgtggggcgaaagggacccg

SEQ ID NO: 786722 - DNA, 466 bp, Homo sapiens
  misc_feature: NA.49.22.B11.1.454.heavy.3.zerom50
agggggctctgggagaggagccccagccctgagattctcaggtgtttcctttcagtgatcagcactgaccacagaggactcaccatggaattgggactgagctggattttccttttggttattttaaaaggtgtccactgtgaagtaatattggtggagtcggggggagacttggtacagcctggcaggtccctgagactctcctgtgaagcctctggactcactttcgaggattatgccatgcactgggtccggcaagctccaggaaagggcctggagtgggtcgcaggtcttagctcgaatagtgatgacatagcctatgcggactctgtgaagggccgattctccatttccagagacaacgccaggaggtccctgtttctgcagatgaatagactgagagatgaggacacggccttatattattgtgttaaagatgtctcgtctacactattttactactata

SEQ ID NO: 786723 - DNA, 484 bp, Homo sapiens
  misc_feature: NA.21.75.G09.1.454.heavy.3.zerom50
agggggggagaggagccccagccgtgagattcccaggagtttccacttggtgatcagcactgaacacagaccaccaaccatggagtttgggcttagctgggttttccttgttgctactttaaaaggtgtccaatgtgaggtgcagctggtggagtctgggggagatttggtacagccagggcggtccctgagactctcctgtacaacctctggattcacctttggtgattatgctatgagctggttccgccaggctccagggaaggggctggagtgggttggtttcgtcagaagcaaagattatggtggaacaccagattacgccgcgtctgtgaaagacagattcacaatctcaagagatgattccaaaagcatcgcctatctgcaaatgaacagcctgaagaccgaggacacagccgtgtattactgtacctcgagaccctcccgtataagtgggacctgtctttgactacgtggggccaac

SEQ ID NO: 786724 - DNA, 478 bp, Homo sapiens
  misc_feature: NA.17.42.D09.1.454.heavy.3.zerom50
agggaaaggggtgggcggcaactatgcaaatgcaagtgggggcctctccacttaaacccagggctcccctccacagtgagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggacggcctcggaccaccgccatattaac

SEQ ID NO: 786725 - DNA, 455 bp, Homo sapiens
  misc_feature: NA.10.7.A07.1.454.heavy.3.zerom50
aggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggggcagttggtggagtctgggggaggcgtggtccagcctgggaggtccctgagactctcctgtgcagcctctggattcatcttcagttgctgtggcgttcactgggtccgccaggctccaggcaaggggctggactgggtggcagtaatatcagatgatggaagtactgtatactacgcagactcagtgaagggccgattcactatctccagagacaattccaagaacacagtgtctctccaaatgaacagcctgcgacctgaggacgcgggtgtctattactgtgcgaaagagggtattgggaatcgttt

SEQ ID NO: 786726 - DNA, 488 bp, Homo sapiens
  misc_feature: NA.19.3.A03.1.454.heavy.3.zerom50
aggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctggtcaagcctggggggtccctgagactctcctgtgcagcctctggattcgatttcgataattatggcatgaattgggtccgccaggctccagggaaggggctggagtgggtctcttccattaataaacatgccagtgacatgtactacgcagacgcactggagggccgattcaccatctccagagacaacgccaggagctcactgtttcttcacatgaacaacctgacccccgaggatacagctatatattattgtgggagagaaagagtggggggaggtccgtcttgggccagggaacccggggtcgccggtctcccg

SEQ ID NO: 786727 - DNA, 456 bp, Homo sapiens
  misc_feature: NA.8.26.C04.1.454.heavy.3.zerom50
agggttggtacagcctggggggtccctgagactctcctgtgcagcctctggattcacctctggcagctttgtcatgagctgggtccgccaggctccagggaaggggctggagtgggtctcatctatgagtggtagtggtggtcacacacactacgcagactccgtgaagggccggttcaccatctccagagacaattccaagaacacggtgtatctgcaaatgaacagcctgagagccgaggacacggccgtatattactgtgcgaaagattttgtttcggaggacctctattattactacggtatggacgtctggggccaagggaccacggtcaccgtctcctcagcctccaccaagggcccatcggtcttcccctggcaccctcctccaagagcacctctgggggcacgagsggccctgggctgcctggtcaaggactacttccgacacgcgag

SEQ ID NO: 786728 - DNA, 506 bp, Homo sapiens
  misc_feature: NA.12.48.E04.1.454.heavy.3.zerom50
agggcttcattttctgtcctccaccatcatggggtcaaccgccatcctcgccctcctcctggctgttctccaaggagtctgtgccgaggtgcagctggtgcagtctgaagcagaggtgaaagagcccggggagtctctgacgatctcctgtaagggttctggatacgactttcccacccactggatcggctgggtgcgccagatgcccgggaaaggcctggagtggatggggattatctatcccggtgactttgataccagatacagtccgtcattccaaggccaggtcaccatctcagtcgacaagtccatcaacaccgcctacctgaagtggaggagcctgagggccgcggacaccgccatgtattactgttgcgagactcgcaaatatcgaacaaaggatattgtacttttacccgagtttcgccgttycccctctcgtasgtacgtygggggwcccgaacgggggaaccccgttcgggtacctacccggttcctcccgtccg

SEQ ID NO: 786729 - DNA, 447 bp, Homo sapiens
  misc_feature: NA.22.69.G03.1.454.heavy.3.zerom50
agacttggtacagcctggggggtccctgagactctcctgtgtaacctctggattcacctttaggagctatgccatgatgtgggtccgccaggctccagggaaggggctggagtgggtgtcaacgattagtggaagtggtactggtatatactacgcagactccgtgaagggccggttcaccctctccagagacaattccaagaatacggtgtatctgcaaatgaacagcctgagagccgaggacacggccgtatattactgtgcgaatcaaaagttcggggacgtccgattcgatatggacgtctggggccaagggaccacggtcaccgtctcctcagcctccaccaagggcccatcggtcttccccctggcgccctgctccaggagcacctccgagagcacagcggccctgggctgcctggtcaaggactacttccagacgtatca

SEQ ID NO: 786730 - DNA, 344 bp, Homo sapiens
  misc_feature: NA.13.58.F03.1.454.heavy.3.zerom50
aagggaaggggctggagtgggtttcatatatcactggtgatagtgcttccacatattacgcagactctatgaagggccgattcaccatctccagagacaatgccaggaactcgctgtatctgcaaatgaacagcctgagagcccgaggacacggctgtctattactgtgcgaaagccagggggcggtttattgactactggggccagggaagtcctggtcaccgtctcctccagccgtccaccaagggcccatcggtcttccccctggcaccctcctccaagagcacctctgggggcacagcggccctgggctgcctggtcaaggactacttcctagtacgtga

SEQ ID NO: 786731 - DNA, 587 bp, Homo sapiens
  misc_feature: NA.7.14.B03.1.454.heavy.3.zerom50
ttggatttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagttgggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttccccctggcaccctcctccaagagcacctctgggggcacagcggccctgggctgcctggtcaaggactacttcctagagacacg

SEQ ID NO: 786732 - DNA, 458 bp, Homo sapiens
  misc_feature: NA.15.50.E06.1.454.heavy.3.zerom50
tctgagagaggagccttagccctggattccaaggcctatccacttggtgatcagcactgagcaccgaggattcaccatggaactggggctccgctgggttttcctcgttgttattttagaaggtgtccagtgtgaggtgcagctggtggagtctgggggaggcctggtcaagcctggggggtccctgagactctcctgtgaagcctctggattcaccttcaaaacatataccatgaactgggtccgccaggctccagggaaggggctggagtgggtctcatccatctctggtagtggcagtcacatatattacgcagactcagtgaagggccgattcaccatctccagagacaacaccaagaactcactgttcctgcaaatgaacagcctgagagccgaggatacggctgtatattactgtgcgcgggagccvatattttcgactatttttccttacg

SEQ ID NO: 786733 - DNA, 513 bp, Homo sapiens
  misc_feature: NA.16.1.A01.1.454.heavy.3.zerom50
agggtgtccttgggttttggggggaagaggaagactgacggtccccccaggagttcaggagtcgggcccaggactggtgaggccttcagagaccctctccctcacctgcgcggtctctggtgactccatgaacagtggtggtacctactggagctggatccgccagcagccagggaagggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcggagggcttttgatttctggggccaagggacagtggtcaccgtctcttcagcctccaccaagggcccatcggtcttccccctggcaccctcctccaagagcacctctgggggcacagcggccctgggctgcctggtcaaggactacttccgagtagtactacg

SEQ ID NO: 786734 - DNA, 368 bp, Homo sapiens
  misc_feature: NA.40.80.H03.1.454.heavy.3.zerom50
aagggaaagggcatggagtgggtggccttcatcaggagcaaagccaacggtgggacagcacaatacgccgcgtctgtgagaggcagattctccgtctcaagagatgattctaagaacatcgtctatctgcaaatgaacagcctgacaaccgaggacacagcccaatatttttgtactacccaggatcagtatgagagacgtggtgtttctcagtattttgaatactggggccacggagcgctggtcatcgtctcctccgcctccaccaagggcccatcggtcttccccctggcaccctcctccaagagcacctctgggggcacagcggccctgggctgcctggtcaaggactacttccagtcgctaga

SEQ ID NO: 786735 - DNA, 461 bp, Homo sapiens
  misc_feature: NA.26.72.G06.1.454.heavy.3.zerom50
acccaaaaaccacacccctccttgggagaatcccctagatcacagctcctcaccatggactggacctggagcgtccttttcttggtggcagcagcgacaggtgcccactcccaggttcagctggtgcagtctggaggtgaggtgaagaagcctggggcctcagtgaacgtctcctgcaaggcttctggttacagctttaccgactatggtatcacctgggtgcgacaggcccctggacaaggacttgagtggatgggatggatcagcccttataatggtaacacgaagtatgcaccgaagctccagggcagactctccatgaccacagacacatccacgagcacaacatacatggaattgaggagcctgagatctgacgacacggccatgtattactgttcgagagggtacggtgacacgaacaactggggccagggaaccctggtcaccgtctcctcacg

SEQ ID NO: 786736 - DNA, 344 bp, Homo sapiens
  misc_feature: NA.47.68.G02.1.454.heavy.3.zerom50
ctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 786737 - DNA, 462 bp, Homo sapiens
  misc_feature: NA.53.71.G05.1.454.heavy.3.zerom50
atactttctgagactcatggacctcctgcacaagaacatgaaacacctgtggttcttcctcctgctggtggcagctcccagatgggtcctgtcccaagtgcggctgcaggagtcgggcccaggactggtgaagccttcggagaccctgtccctcacctgcgctgtctctggtgactccatcagtgatttctactggaactggatccgccagcccgccgggaagggactggagtggatcggccgtatccatcatagcgggagcaccaactacaacgcctccctcaagggtcgagtcgccatgtcactcgacacgtccaagaacctgttctccctgaggctgacctctgtgaccgcctcggacacggccgtatattactgtgcgagagagtcttattgtgctggtaataactgctacatcctctttgactttctggggcccgggaaccctgggtcaccgtctcc

SEQ ID NO: 786738 - DNA, 538 bp, Homo sapiens
  misc_feature: NA.22.33.C11.1.454.heavy.3.zerom50
ttgggtttgggctgagctgggttttcctcgttgctcttttaagaggtgtccagtgtcaagtgcaactggtggagtcgtggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttcgtggggccagggaaccctggtcaccgtctcctcagcctccaccaagggcccatcggtcttccccctggccgccctgctccaggagcacctccgagacgcacagcggcctgggctgcctggtcaaggactacttccagacgtatca

SEQ ID NO: 786739 - DNA, 447 bp, Homo sapiens
  misc_feature: NA.17.39.D06.1.454.heavy.3.zerom50
cagttctttgggggggagaggagcccagcactagaagtcggcggtgtttccattcggtgatcagctctgagcacagaggactcaccatggagtttgggctgagctgggttttcctcgtcgctcttttcagaggtgtccagtgtcaggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatgtggtatgatggaagtaatcaatactatgtagactccgtgaagggccgattcaccatctccagagacaattccaagaacacgctgtatctgcaaatgaacagcctgagagtcgaggacacggctgtgtactactgtgcgagaggtctcgggt

SEQ ID NO: 786740 - DNA, 455 bp, Homo sapiens
  misc_feature: NA.9.81.H04.1.454.heavy.3.zerom50
agctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtctgggggaggcttggtgcagcctggcacctccctgagactctcctgtgccgcctctggattcatgtttgatgattatgccatgcactgggtccggcaagttccagggaagggcctggagtgggtctcaggtattacttggagtagcactaccacaggctatgcggactctgtgaggggccgattcaccatctccagagacaacgccaagaactccctatatctgcaaatgaatggtctgagagttgaggacacggccttgtattactgtgcaaaagataggaaaccccaggtggacgct

SEQ ID NO: 786741 - DNA, 476 bp, Homo sapiens
  misc_feature: NA.49.56.F01.1.454.heavy.3.zerom50
aacacacaaagggggctttctgagagtcatggatctcatgtgcaagaaagtgaagcacctgtggttcttcctcctgctggtggcggctcccagatgggtcctgtcccagctgcagctacaggagtcgggcccaggactgctgaagccttcggagaccctgtccctcacctgcactgtctctggtggttccttcagtagtccttattactactggggctgggtccgccagcccccagggaagggcctggagtggattgcgaatatctactatagtgggagcacctactacaatccttccctcaagagtcgcgtcactgtgtccgtggacacgtccaagaataaagtctccctgaacctgaactctgtgaccgccgcagacacggctgtctattactgtgccagaacgcggaaatccctacacaatgatgcttttgattgtctggggccagtgggacaatggtcaccrycksttcacg

SEQ ID NO: 786742 - DNA, 501 bp, Homo sapiens
  misc_feature: NA.40.16.B05.1.454.heavy.3.zerom50
agggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgcccgccgggcagggactggagtggattgggcgcgtctatcacagtgaaaccagctacatcccctccctcgagagtcgagtcaccatttcactagacacgtccacaaatcagttgtccctgaggctgagctctgtgaccgccgcggacacgggcgtatattactgtgcgaggaggggggccggggggaaactcctatggctcctttgactactggggccagggaaccctggtcaccgtctcctcagcctccaccaagggcccatccggtcttcccccgtggccgccctgcctccaggagcctacccgaccccg

SEQ ID NO: 786743 - DNA, 467 bp, Homo sapiens
  misc_feature: NA.3.81.H04.1.454.heavy.3.zerom50
ctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctgggctgcctggtcaaggactacttccgagtgcgtcttcsttac

SEQ ID NO: 786744 - DNA, 337 bp, Homo sapiens
  misc_feature: NA.4.29.C07.1.454.heavy.3.zerom50
agggaaaggggctggagtgggttggccatattaaaagcaaatctgatggtgggacaatacactacgctgcacccgtgaaaggcagattcaccatctcaagagacacttcaagaaattcattgtatctgcaaatgaacagtttgaaaaccgaggacacagccgtgtattattgtacagctggacactattctccctggggccagggaaccctggtcaccgtctcctcagcctccaccaagggcccatcggtcttccccctggcgccctgctccaggagcacctccgagagcacagcggccctgggctgcctggtcaaggactacttccctacagtgct

SEQ ID NO: 786745 - DNA, 469 bp, Homo sapiens
  misc_feature: NA.53.52.E08.1.454.heavy.3.zerom50
agagagaaagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagttggtggagtccgggggaggcgtggtccagcctgggaggtccctgagactctcctgtgtagcctctggattcaccttcagggtctatggcatgaactgggtccgccagactccaggcaaggggctggagtgggtggcatttatatcatttgatggcactaataaatactatgcagactccgtgaggggccgattcaccatctccagagacaattccaagaagatggtgtttctgcaaatgaacagcctgagagttgaagacacggctgtgtattactgtgcgaaacggaatggagtgggaacgtaggggtcg

SEQ ID NO: 786746 - DNA, 475 bp, Homo sapiens
  misc_feature: NA.15.23.C01.1.454.heavy.3.zerom50
tagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccagccgggggggtccctgagactctcctgtgccgcctctggactcacctttagtagctattggatgagctgggtccgccaggctccagggaaggggctggagtgggtggccaacataaaggaagatggaagtcagaaacactatgtggactctgtgaagggccgattcaccatctccagagacaacgccaagaattcagtgtatctgcaaatgaacagcctgagagccgaggacacggccgtgtattactgtgtgagagacatgacaacggtgaataaccgggaggggttgt

SEQ ID NO: 786747 - DNA, 442 bp, Homo sapiens
  misc_feature: NA.51.48.E04.1.454.heavy.3.zerom50
ctctgggagaggagcccagcactagaagtcggcggtgtttccattcggtgatcagcactgaacacagaggactcaccatggagtttgggctgagctgggttttcctcgctgctcttataagaggtgtccagtgtcaggtacaactggtggagtctgggggaggcgtggtccagcctgggaggtccctgagactctcctgtgcagcctctggattcactttcagaacttatgggatccactgggtccgccaggctccaggcaaggggctggagtgggtgtcacttatatcatatgatggaagaaacaaacattatgcagactccgtgcagggccgattcacaatctccagagacaattccaagaacacggtgtttttgcaaatgaacagcctgagaggtgaggacacggctgtctattactgtgcgaaggagaagtattttca

SEQ ID NO: 786748 - DNA, 344 bp, Homo sapiens
  misc_feature: NA.12.72.G06.1.454.heavy.3.zerom50
ctggagtgggtctcaggtattagtggaagtggagcaaccacatactacgcagactccgtaaagggccgattcaccatctccagagacaataccaacaacactctgtatctgcaactgaacggcctgagagccgaggacacggccctttattactgtgcgaaagatcgggtaactttagcagcggctggttactttgactactggggccagggaaccctggtcaccgtctcctcagcctccaccaagggcccatcggtcttccccctggcaccctcctccaagagcacctctgggggcacagcggccctgggctgcctggtcaaggactacttcctacgtcgtat

SEQ ID NO: 786749 - DNA, 482 bp, Homo sapiens
  misc_feature: NA.53.67.G01.1.454.heavy.3.zerom50
ttgggtttgggggagagcatcacataacaaccagattcctcctctaaagaagcccctgggagcacagctcatcaccatggactggacctggaggttcctctttgtggtggcagcagttacaggtgtccagtcccaggtccagttggtgcagtctggggctgagttgaagaagcctgggtcctcggtgaaggtctcctgcaagtattctggaggcaccttcaacaactatggtatcagctgggtgcgacaggcccctkggacaagggcttgagtggatgggaagggtcacccctatttttgatgaagcagactctgcacagaagttccagggcagattaacgattacggcggacaagtccacgactaccgcctacatggagctgaccagtctgaaatctgaggacaacgggccctttaattactgtgcgagatataccgtggggggttacgggcggagatatcgccatactactcgactactc

SEQ ID NO: 786750 - DNA, 483 bp, Homo sapiens
  misc_feature: NA.18.85.H08.1.454.heavy.3.zerom50
tcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcagtttcagtgcctactggatgcactggatccgccaagttccagggaagagactggtgtgggtctcacgtattaaagatgatgggggtgccacatcctacgcggactccgtgaggggccgcttcaccatctcccgagacaacaccaagaacacgctgtatctgcaaatgagcagtctgggagtcgaggacacggctgtctattactgtgcaaggaggggactacggtgcctacggagggggttggtccgaccccgtgggggccagggaaccctggtccaccgtctccctcacg

SEQ ID NO: 786751 - DNA, 485 bp, Homo sapiens
  misc_feature: NA.52.52.E08.1.454.heavy.3.zerom50
agagagaaaggggatactttctgagactcatggacctcctgcacaagaacatgagacacctgtggttcttcctcctcctggtggcagctcccagatgggtcctgtctcaggtgcagctgcaggagtcgggcccaggactggtgaagccttcggggaccctgtctctcacctgcgctgtctctggtgggtccatcagaagtagtaactggtggagttgggtccgccagcccccagggaagggtctggagtggattggggaaatctatcatactgggaacaccaactacagcccgtccctcaagagtcgagtcgccatatcactagaccaggcgaacaacgagttctccctgaaactgagctctgtgaccgccgcagacacggccgtgtattattgtgggagagatcggagagatagtagtggtttttactacggtgactacgacggtatggacgtcgtggggccaagggaccacggtcatcgtccg

SEQ ID NO: 786752 - DNA, 477 bp, Homo sapiens
  misc_feature: NA.17.26.C04.1.454.heavy.3.zerom50
aagtagtcctgtcccagctgcagctgcaggagtcgggcccaggactggtgaagccttcggagaccctgtccctcacctgcactgtcactggtgactccatcagcagtagtagttactactggggctgcatccgccagcccccagggaaggggctggagcggattgggagtatccattatagtgggagcacccactacaacccgtccctcaagagtcgaatcaccatgtccgtagacacgtccaagaaccggttctccctgaaactgagctctgtgaccgccgcagacacggctgtgtattactgcatagcaatagcacagtacggaatggacgtctggggccaagggaccacggtcaccgtctccctggcctccaccaagggcccatcggtcttcccctggcaccctcctccaagagcacctctgggggcacagcggccctgggctgcctggtcaaggactacttccctagtctacg

SEQ ID NO: 786753 - DNA, 487 bp, Homo sapiens
  misc_feature: NA.19.48.E04.1.454.heavy.3.zerom50
tctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccggggaaggggccggagtgggtggccaacataatgcaagatggaactgagaaaaactatggggactctgtgaagggccgattcaccatctccagagacaaccgtaagaacttactgtttctgcaaatgaacagcctgagagccgaggacacggctgtgtattattgtgcgaagggcagtggctgggacatggacgtcgtggggccaaggggaccacggtcaccgttccctccg

SEQ ID NO: 786754 - DNA, 459 bp, Homo sapiens
  misc_feature: NA.53.79.H02.1.454.heavy.3.zerom50
agggaaagggggggagaggagcccagcactagaagtcggcggtgtttccattcggtaatcagcactgaacacagaggactcaccatggagtttgggctgagctgggttttcctcgttgctcttttaagaggtgtccagtgtcaggtgcaactggtggagtctgggggaggcgtggtccagcctggggagtccctgagactctcctgtgaggcgtctggattcaccttcagcaactatgccatgcactgggtccgccaggctccaggcaagggtctggagtgggtgtcagtaatatggtttgattcaagtaatacatactatgcagactccgtgcagggccgattcaccatctccagagacaattccaagagcacactgtatctggaaatgaacaatgtgagagtcgaggacacgggtgtctattactgtgacgaaacatcaggcagcagctgggacgtt

SEQ ID NO: 786755 - DNA, 461 bp, Homo sapiens
  misc_feature: NA.7.28.C06.1.454.heavy.3.zerom50
aggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggccagggaaccctggtcgtccgkct

SEQ ID NO: 786756 - DNA, 467 bp, Homo sapiens
  misc_feature: NA.19.21.B10.1.454.heavy.3.zerom50
aggagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggccccatacgacatgccacctcgtctctggtgct

SEQ ID NO: 786757 - DNA, 452 bp, Homo sapiens
  misc_feature: NA.52.70.G04.1.454.heavy.3.zerom50
acccaacaaccacatccctcctcagaagcccccagagcacaacgcctcaccatggactggacctggaggatcctctttttggtggcagcagccacaggtgcccactcccaggtccaaattgtgcagtctggggctgaggtgaagaagcctggggcctcagtgaaggtttcctgcaaggcttctggatacagtttcactaggtattcgatgcattggctgcgccaggcccccggacaaaggcctgagtggatgggaagtctcagtgatggcaaaggtgacaaaaagtattcacagaagttccagggcagagtcaccattaccagcgacgcatccgcgaacacagcctatatggaactcagcagcctgagatctgaagacacggctgtctattactgtgcgagggtcggcacgctgacaacctcttacttctattcctacgctatggacgtctc

SEQ ID NO: 786758 - DNA, 344 bp, Homo sapiens
  misc_feature: NA.12.69.G03.1.454.heavy.3.zerom50
ctggagtgggtggccaacataaaggaggatggaactaagaaatattatgtggactctgtgagggcccgattcaccgtctccagagacaacgccaagaactctctgtttctgacaatgaacagcctgagagccgaggacacggctgtatattactgtgcgcgagagcggcgtagcggttaccaacccaactactttgacttctggggccagggaaccctggtcaccgtctcctcagcctccaccaagggcccatcggtcttccccctggcaccctcctccaagagcacctctgggggcacagcggccctgggctgcctggtcaaggactacttcctacgtcgtat

SEQ ID NO: 786759 - DNA, 439 bp, Homo sapiens
  misc_feature: NA.51.32.C10.1.454.heavy.3.zerom50
agctctgggagaggagccccaggcccgggattcccaggtgtttccattcagtgatcagcactgaagacagaagactcatcatggagttctggctgagctgggttctccttgttgccattttaaaagatgtccagtgtgaggtgcggctgatagaatctgggggaggcttggtccagcctggggggtccctgagactctcctgttcagcctctggattcaccttcagtaggaatcctatgcactgggtccgccaggctccaaggaagggactggaatatgtttcagctattacttttgatgggagtggcacatcctatgcagactccgtgaagggcagattcaccatgtccagagacaattccaaaaacacgactgtatcttcaaatgagcagtctgagagctgaggacacggctatctattactgtgtgaaagagggta

SEQ ID NO: 786760 - DNA, 479 bp, Homo sapiens
  misc_feature: NA.13.75.G09.1.454.heavy.3.zerom50
agggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggccccgaaagaggaaagtggctacgatttgggaagtactactacatggacgtctggggcaaagggaccacggtcaccgtctcctcagt

SEQ ID NO: 786761 - DNA, 465 bp, Homo sapiens
  misc_feature: NA.15.20.B09.1.454.heavy.3.zerom50
aggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatgcagagaagttccagggcagagtcatcatcaccgcggacacatccacgagtacagcctacatggaactgaggagcctcagatctgacgacacggccacttattactgcgcgagagattattgcactggtcctggctgtaaccacgcttgtgggcactggggccacggta

SEQ ID NO: 786762 - DNA, 480 bp, Homo sapiens
  misc_feature: NA.40.10.A10.1.454.heavy.3.zerom50
aggggggtctcagagaggagccttagccctggactccaaggcctttccacttggtgatcagcactgagcacagaggactcaccatggaattggggctgagctgggttttccttgttgctattttagaaggtgtccagtgtgaggagcagctggtggagtctgggggaggcttggtccagcctggggggtccctgagactctcctgtgttgcctctgggttcacatttcgtaacaattggatgacctgggtccgccaggctccagggaaggggctggagtgggtggccaatataaaccgagatggaaataagatatactatgtggactctgttaagggccgattcaccatctccagagacaacgccaagagttcactgtttctgcaaatgagcagcctgagagccgaggacacggctctatattactgtacgagagatttcagcccctcccaaagtggaaatttattaatagaatggactt

SEQ ID NO: 786763 - DNA, 461 bp, Homo sapiens
  misc_feature: NA.4.18.B07.1.454.heavy.3.zerom50
aagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgaccagggacacgtccttcagcacagcctacttggaggtgagcaggctgagatctgacgacacggccgtgtattactgtgcgagagaggaagacttgagtcggatacagctgtggttaagaggtacc

SEQ ID NO: 786764 - DNA, 463 bp, Homo sapiens
  misc_feature: NA.9.28.C06.1.454.heavy.3.zerom50
actcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcatcccccaggaaaggccctggaatggcttgcattcgtttattggaatgatgataaacgctacagcccatctctgaggaccaggctcaccattaccaaggacacctccaaaaaccaggtggtccttacaatgaccaacatggaccctgtggacacagccacatattactgtgcacacagtgtcatgactgcggtgactgttctcccctttggctactggggccagggaaccctggtcaccgtctcctcagcctccaccaagggccctacg

SEQ ID NO: 786765 - DNA, 450 bp, Homo sapiens
  misc_feature: NA.4.43.D10.1.454.heavy.3.zerom50
agggggctctgggagaagagccccagccccagacttcccaggagattccattcggtgatcagcactgaacacagaggactcaccatggagtttgggctgagctgggttttccttgctgctattataaaaggtgtcctgtgtcaggtgcacctggtggagtctgggggagccttggtcaagcctggagggtccctgagactctcctgtgcgacctctggattcaccttcagtgactaccagatgagctgggtccgccaggctccagggagggggctggagtggctttcatacatcactagtcgtactgagagtgcacactacgcagtctctgtgaggggccgattcaccatctccagggacaacgccaagcactcactgtatctgcagatgaacagcctgagagccgaggacacggccgtctattactgtgcgagagamgtacgaggggta

SEQ ID NO: 786766 - DNA, 345 bp, Homo sapiens
  misc_feature: NA.10.60.F05.1.454.heavy.3.zerom50
gggaaagggcctggagtgggtctcaggtattacttggaatggtggtataataggctatgcggactctgtgaggggccgcttcaccatctccaaggacagcgccaagagatccctctatctgcaaatgaacagtctgagaactgaggacacggcctactactactgtgcaaaagatgattccggcagttacttcttagataactggggccggggaaccctggtcgccgtctcttcagcctccaccaagggcccatcggtcttccccctggcgccctgctccaggagcacctccgagagcacagcggccctgggctgcctggtcaaggactacttcccactactatg

SEQ ID NO: 786767 - DNA, 474 bp, Homo sapiens
  misc_feature: NA.40.73.G07.1.454.heavy.3.zerom50
agggcacgaccggtgctcgatttagacgtctcatcaaggaaggaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattactccctgaagctgagctctgtgaccgccgcagacacggctgtctattactgtgcgaggccccgagcgcagtggtcctttttgatgtgcctttcgtatatggtkgggkacc

SEQ ID NO: 786768 - DNA, 604 bp, Homo sapiens
  misc_feature: NA.17.37.D04.1.454.heavy.3.zerom50
ttgggtttgggggagccccagccctgggattcccagctgtttctgcttgctgatcaggactgcacacagagaactcaccatggagtttgggctgagctgggttttccttgttgctattttaaaaggtgtccagtgtgcggtgcagctggtggagtccgggggaggtttagttcagcctggggggtccctgagactctcctgtgcggcctctggattcaccttcagtagctactggatgcactgggtccgccaagctccagggaaggggctggtgtgggtctcacgtattgatactgatggcattaccacatcctacgcggactccgtgcagggccgattcaccatctccagagacaacgccaagaacacgctgtatctgcaaatgaacagtctgagagccgaggacacggctgtgtactactgtgcaagagtttcccccggcagctcgcccggtaacttctggggccagggaacccgaggtcaccgtctcctcagcctccaccaagggcccatcggtcttccccctggcaccctcctccaagagcacctctgggggcacagcggccctgggctgcctggtcaaggactacttccctagtctacg

SEQ ID NO: 786769 - DNA, 570 bp, Homo sapiens
  misc_feature: NA.9.38.D05.1.454.heavy.3.zerom50
ttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctggggcccgggaaccctggtcaccgtctcctcagcctccaccaagggcccatcggtcttccccctcgcgccctgctccaggagcacctccgagagcacagcggccctgggctgcctggtcaggactacttccagacgtatca

SEQ ID NO: 786770 - DNA, 474 bp, Homo sapiens
  misc_feature: NA.4.39.D06.1.454.heavy.3.zerom50
cagttctttgggttttggggggaagtgtggtacggcctggggggtccctgagactctcctgtacagcctctggattctcctttgatgattatggcatgagctgggtccgccaagctccagggaaggggctggagtgggtgtctggtatgaattggagtggcggtagtacagcttatgcagactctgtgaagggccgattcaccatctccagagacaacgccaagaactccctgtatctgcaattgaacagtctgagagccgaggacacggccttgtattactgtgcgagaacatttagggtgtgtagtggtaacagctgctattcgtcgactgggtttgactactggggccagggagccctggtcaccgtctcctcagcctccaccaagggcccatcggtcttcccctggcgccctgctccaggagcacctccgagagcacagcggccctgggctgcctggtcaaggactaccg

SEQ ID NO: 786771 - DNA, 464 bp, Homo sapiens
  misc_feature: NA.51.47.E03.1.454.heavy.3.zerom50
agagagaagggggtgactcctgtgccccaccatggacacactttgctccacgctcctgctgctgaccatcccttcatgcgtcttgtcccagatcaccttgaaggagtctggtcctacgctggtgaagcccacacagaccctcacgctgacctgcaccttctctgggttctcactctccagtcctggagtggctgtgggctggatccgtcagcccccaggaaaggccctggagtggctggcactcatttattggaatgacgataagacctacagcccatttctgaagaacaggctcaccatcaccaaggacacctccaagaaccaggtgctccttagactgaccaacatggaccctgtggacacagccacatattactgtgtacacgtccccccgccgtacttattatgatgctagtggttattccaacgctgaatacttccagcactggggccagggcaacccs

SEQ ID NO: 786772 - DNA, 475 bp, Homo sapiens
  misc_feature: NA.16.5.A05.1.454.heavy.3.zerom50
aggggagctctgggagaggagcccagcactagaagtcggcggtgtttccattcggtgatcagcactgaacacagaggactcaccatggagtttgggctgcgctgggttttcctcgttgctcttttaagaggtgtccagtgtcaggtgcaactggtggagtctgggggaggcgtggtccatcctgggaagtccctgacactctcctgcgtagcctctgggttcgtcttcaggaattatggcatgcactgggtccgccaggctccaggcaaggggctggagtgggtggcggttatttcatatgatggaaataagaaagactatgcagactccgtgaagggccgactcaccatctccagagacaattaccaaaaacacggtctatctgcacctagaacagcctgagacctgaggacacggctattgttttacttgtgcgaaagtcctcgacttatgatcttttgactggtctacttta

SEQ ID NO: 786773 - DNA, 482 bp, Homo sapiens
  misc_feature: NA.52.74.G08.1.454.heavy.3.zerom50
aggggatgctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagtggttattattgggcctggatccggcagccccccgggaaggggctggagtggatcggcagcatccatcatagtggagacaataatcacaatccgtccctcagaggacgagtcaccttttcagtggagacgtccaagaaccaattctccctgaaattgacctctctgaccgccgccgacacggccctttattactgtgcgcgagtgaacacagcaataacttattatgttgaatattggggccagggaaccccggtcaccatctcctcagcctccaccaagggccccatccg

SEQ ID NO: 786774 - DNA, 458 bp, Homo sapiens
  misc_feature: NA.49.7.A07.1.454.heavy.3.zerom50
aggggctgggagtcgagcccagcactgggagtcgccggtgtttccattcggtgatcatcactgaacacagaggactcaccatggagtttgggctgaactgggttttcctcgttgctcttttaagaggtgtccagtgtcaggtgcagttggtggagtctgggggaggcgtggtccagcctgggaggtccctgagactctcctgtgcagcctctggattcaccttcaatagttatggtttgcactgggtccgccaggctccaggcaagggtctggagtgggtggcttttatatcctatgatggtagcgataagtactacgcagattccgcgaagggtcgattcaccatctccagagacaagtccaagaagacgctgtatctggacatgaccagcctgagatctgaggacacggctgtctacttctgtgcgagaggcaccgagcagcgagtccaccctacg

SEQ ID NO: 786775 - DNA, 587 bp, Homo sapiens
  misc_feature: NA.51.49.E05.1.454.heavy.3.zerom50
aacacacaaagggggtggtttctgagagtcatggacctcctggacaagaacatgaaacccctgtggttcttcctcctcctggtggcagctcccagatgggtcctgtcccaggtgcaactgcagcagaggggcgcaagactgttgaagcctttggagaccctgtccctcacctgcactctttctggtgcgactttcagtggttatttctggggctgggtccgccagccccccgggaagggacttcagtggattggggaaatcagtcgtagtggagagaccttctacaacccgtccctcaagagtcgagtcgccatatcaacagacgcgtccaagagtgaggtgtccctgacactcaggtctgtgaccgccgcggacgcggctgtatactactgtgcgagagtccccgctgggttttggagtggttattatgccggtatggacgtctggggcgcagggaccacggtcgccgtctcttcagcctccaccaagggcccatcggtcttccccctggcaccctcctccaagagcacctctgggggcacagcggccctgggctgcctggtcaaggactacttcctcgtagcact

SEQ ID NO: 786776 - DNA, 456 bp, Homo sapiens
  misc_feature: NA.49.47.E03.1.454.heavy.3.zerom50
agagagaagggggcatcatccaacaaccacatcccttctctacagaagcctctgagagggaagttcttcaccatggactggacctggagggtcttctgcttgctggctgtagctccgggtgctcactcccaggtgcagttggtgcagtctggggctgaggtgaagaagtctggggcctcagtgaagatttcctgcaaggcttctggataccccttcaccatctaccacatgcactgggtgcgacaggccccgggacaagggcttgagtggatgggaataatcaaccctagtggtggtagcacaacctccgcacagaggttccagggcagagtcaccatgaccagggacacgtccacgagcacattctacatggaactgagccgcctgagatctgacgacacggccgtgtactactgtgcgagagtcactcattwactacgatwawgtttatggtcg

SEQ ID NO: 786777 - DNA, 452 bp, Homo sapiens
  misc_feature: NA.4.7.A07.1.454.heavy.3.zerom50
aggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagatttggggaatgaccacgtc

SEQ ID NO: 786778 - DNA, 449 bp, Homo sapiens
  misc_feature: NA.17.36.D03.1.454.heavy.3.zerom50
atctctcttggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtaccgcctggggggtccctgagactctcctgtagagcctctggattcgccttcagtacctacagcatgaactgggtccgccaggttccagggaagggtctggagtgggttgcatacattagtagtagtgatagttccatatactacgcagactctgtgaagggccgattcaccatctccagagacagtgccaagaactcactgtatctgcaaatgaacagccttagagacgacgacacggctgtgtattactgtgcgagagatccgctgg

SEQ ID NO: 786779 - DNA, 350 bp, Homo sapiens
  misc_feature: NA.16.72.G06.2.454.heavy.3.zerom50
ctggagtgggtctcatctattagtagtagtgatagtgccacatactacgcagactccgtgaagggccggttcaccatctccagagatagatccaagaacacgctgtatctgcaaatggacagcctgagagccgaggacacggccatatattactgtgcgaaagatctggggaatgactacgatggtaccaacgtccgcttggactcctggggccagggagccctggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 786780 - DNA, 344 bp, Homo sapiens
  misc_feature: NA.17.61.F06.1.454.heavy.3.zerom50
ctggagtgggtctcaactatcagtggtagtggtgttagcacatattacgcagactccgtgaagggccggttcaccatctccagagacaattccaagaacacgctgtatgttcaaatgaacagcctgagagccgaggacacggccgtatattactgtgcgaaagaccttgtgtatagcagtgcctggtaccaaggtgactactggggccagggaaccctggtcaccgtctcctcagcctccaccaagggcccatcggtcttccccctggcaccctcctccaagagcacctctgggggcacagcggccctgggctgcctggtcaaggactacttccctagtctacg

SEQ ID NO: 786781 - DNA, 613 bp, Homo sapiens
  misc_feature: NA.18.87.H10.1.454.heavy.3.zerom50
ttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctgkttgggtttgggggaggcttggtccagcctggggggtccctgagactctcctgtgcaggccctgcattcatctttaatagttattggatgcactgggtccgccaggctccggggaaggggccggagtgggtggccaacataatgcaagatggaactgagaagaactatgtggactctgtgaagggccgattcaccatctccagagacaacactaagaacttactgtatctgcaaatgaacagcctcagagccgaggacacggctgtgtattactgtgcgaagagcagtggctgggacatggacgtctggggccaagggaccacgggtcaccgtctcctcagcctccaccaagggcccatcggtcttcccctggcgccctgctccaggagcacctccgagagcacagccggcccgtgggctcgcctggtcaaggacgtacttcccatactcgta

SEQ ID NO: 786782 - DNA, 353 bp, Homo sapiens
  misc_feature: NA.3.12.B01.1.454.heavy.3.zerom50
tccgcgggttgtagtcggtgctcccaccatagtgggagcaccgactacaacccgtccctcaagagtcgagtcaccatatcagtagacacgtccaagaatcagatctccctgaacgtgacctctgtgacggccgcagacacggccgtctattactgtgccagttcgtcacatatgcttacgtctgggggagatatcgttttctctgacaactggggccagggttccctggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 786783 - DNA, 467 bp, Homo sapiens
  misc_feature: NA.52.60.F05.1.454.heavy.3.zerom50
gggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactgggtccgccaggcctccaggcaaggggctggagtgggtggcagttatatcatatgatggaagtaagatatactatgcagactccgtagaagggccgattcaccatttccagagacaactccaagaacacgctgtatttgcaaatgaacagcctgagagctggaggacgacggctgtgttattactgtgckaacttaatacwacggaggayaacsgtccg

SEQ ID NO: 786784 - DNA, 443 bp, Homo sapiens
  misc_feature: NA.52.4.A04.1.454.heavy.3.zerom50
aggactggtgaagccttcacagaccctgtccctcacctgcactgtctctggttactccatcagcagtcctgatcactattggagttggatccgccagtccccagggaagggcctggagtggattggatacatttattacagcgggcgcagcaactatagcccgtccctcaggactccagttaccatatcaatagacacgtccaagaaccagttctcactgattctgacctctgtgactgccgcagacacggccgtttactactgtgccagggcccactacgatttcgtttacgtggattcctggggccagggagccctggtcaccgtctccgcggcctccaccaagggcccatcggtcttcccctggcaccctcctccaagagcacctctgggggcacagcggccctgggctgcctggtcaaggactacttcctatacgatcg

SEQ ID NO: 786785 - DNA, 470 bp, Homo sapiens
  misc_feature: NA.52.84.H07.1.454.heavy.3.zerom50
tctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctgggagtgggtggcatttatatcaaatgatggaagtaacaaatactatgtagactccgtgaagggccgattcaccatctcccagagacaattccaagaatacgctgtatctgcacatgaacagcctgagagccgaagacacgggtcgtttattactgtrcgtaacttaagttacggaggacaacgggtaacccccgtccgaccg

SEQ ID NO: 786786 - DNA, 356 bp, Homo sapiens
  misc_feature: NA.3.41.D08.1.454.heavy.3.zerom50
ctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgccctgctccaggagcacctctgggggcacagcggccctgggctgcctggtcaaggactacttccgagtgcgtct

SEQ ID NO: 786787 - DNA, 464 bp, Homo sapiens
  misc_feature: NA.19.5.A05.1.454.heavy.3.zerom50
agggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctctgaggatctcgtgtaagacttctggattcaggtttactacatattggatcggctgggtgcgccagcagcccggacaaggcctggagtggatgggaatcatctatcctggagactctgatgccagatacactccgtccttccaaggccgagtcaccatttcagccgacaagtccatcagcaccgcctacctgcagtggaacagcctgacggcctcggacagcggcgtctattactgtgcgagcattacaaaatggggtggcggcgaggggtggttttgattttcgktacgttttc

SEQ ID NO: 786788 - DNA, 464 bp, Homo sapiens
  misc_feature: NA.48.83.H06.1.454.heavy.3.zerom50
tcgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagttatcatctactacttt

SEQ ID NO: 786789 - DNA, 346 bp, Homo sapiens
  misc_feature: NA.16.77.G11.1.454.heavy.3.zerom50
aagggaagggcctggagtggattgcgactatgtaccatagtgggagcacttactacaacccgtccctcaggagtcgagtcaccacatccgtagacacgtccacgaaccagttctccctgaggctgagctctgtgaccgccgcagacacggctgtttattactgtgtgagacattttcgttttgttatgcggggagttgactactggggccagggaacccgagtcaccgtctcctcagcctccaccaagggcccatcggtcttccccctggcaccctcctccaagagcacctctgggggcacagcggccctgggctgcctggtcaaggactacttccgagtagtaca

SEQ ID NO: 786790 - DNA, 458 bp, Homo sapiens
  misc_feature: NA.51.39.D06.1.454.heavy.3.zerom50
cagtctgggggaggcgtggtccagcctggggggtccctgagactctcctgtgtagcctctggattcagcctcagcacgtatggtttgcgctgggtccgccaggctccaggcaagggactgcagtgggtggcctctatatcatatcaaggaagcaataaatactacgcagactccgtgaagggccgattcaccatctccagagacaatcccaagaacacactttatctgcaaatgaacaccctgagacttgaggacacggctgtctattattgtgcgagagggagatcgatcacagcagccctcgaagaccaacatgatggtgttgatgtctggggccaggggacaatggtcaccgtctctttcagcctccaccaagggcccatcggtcttccccyggcaccctcctccaagagcacctctgggggcacagcggccctgggctgcctggtcaaggacta

SEQ ID NO: 786791 - DNA, 441 bp, Homo sapiens
  misc_feature: NA.14.50.E06.1.454.heavy.3.zerom50
acccaacaaccacatccctcctcagaagcccccagagcacaacgcctcaccatggactggacctggaggatcctctttttggtggcagcagccacaggtgcccactcccaggtccaccttgtgcagtctggggctgaggtgaagaagcctggggcctcagtgaaggtttcctgcaaggcttctggatacaccttcaccacctatgttgttcattgggtgcgccaggcccccggacaaaggcttgagtggatgggatggatcaacgctggcaatggtaacacaaaatattcacagatgtttcagggcagagtcaccattaccagggacacatccgcgagcacagtctacatggagctgagcagcctgagatctgaagacacggctgtgtattactgtgcgagagataagaggcggattggcgatttgtggactccggcgcta

SEQ ID NO: 786792 - DNA, 489 bp, Homo sapiens
  misc_feature: NA.3.27.C05.1.454.heavy.3.zerom50
agggtttggggagcgctgggagaggagccccagccctgagattcccaggtgtttccattcagtgatcagcactgaacacagaggactcaccatggagttgggactgggctggattttccttttggctattttaaaaggtgtccagtgtgaagtgcagttggtggagtctgggggagccttggtacagcctggcaggtccctgagactctcctgtgcagcctctggattcacctttggtgattatgccatgtactgggtccggcaagctccagagaagggcctggagtgggtctcaggtattagttgggatagcggtaccataggctatgcggactctgtgaggggccgattcaccatttccagagacaacaccaagaactccctgtatctgcaaatgaacagtctgagaactgaggacacggccctctattactgtacaagaggtcttaggaggagctggcgaaattggttcgtaccccgtggggaccg

SEQ ID NO: 786793 - DNA, 645 bp, Homo sapiens
  misc_feature: NA.22.30.C08.1.454.heavy.3.zerom50
aagggaaaggggctcagagaggagccttagccccggactccaaggcctttccacttggtgatcagcactgagcacagaggactcaccatgggattggggctgagctggcttttccttgttgctattttagaaggtgtccagtgtgaggtgcgcctggtggaatctgggggggccttggtccagcctggggggtccctgagactcgcctgtgcagcctctggattcgagtttggagcctactgtctgacttgggtccgccaggctccagggaaggggctggagtgggtggccagcatcaacgaagacggacataaggaattttatgtggcctctgtgaagggccgattcaccatctccagagacaacgtcaagaactcactgtttctgcagatggacagcctgcgagccgaggacacggctgtctatttctgtgtcagagacgagatactacagttattcttatgagactagtagtgactatttccctggtgcttttgaattctggggccaagggacaagggtctccgtctcctcagcctccaccaagggcccatcggtcttccccctggcgccctgctccaggagcacctccgagagcacagcggccctgggctgcctggtcaaggactacttccacgcgtatgt

SEQ ID NO: 786794 - DNA, 487 bp, Homo sapiens
  misc_feature: NA.46.33.C11.1.454.heavy.3.zerom50
tgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaagggaggggggaaccgaggcgggagttccaagtactcctttgacgtctggggccagggtacccg

SEQ ID NO: 786795 - DNA, 496 bp, Homo sapiens
  misc_feature: NA.12.39.D06.1.454.heavy.3.zerom50
cagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaagggcccatcggtcttcccctggcaccctcctccaagagcacctctgggggcacagcggccctgggctgcctcgtacg

SEQ ID NO: 786796 - DNA, 477 bp, Homo sapiens
  misc_feature: NA.13.43.D10.1.454.heavy.3.zerom50
aggggctgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttcgactctcctgtgcagcctctggaatcactttcagtgacgcctggatgaactgggtccgccaggctccagggaaggggctggagtggattggccgtattaaaagtgagcctgatggtgggacaacagactacgctgcacccgtgaagggcagattcaccatctccagagatgattcaaggaacacagtgtttctgcaaatgaacagcctgactgccggggacactgccgtgtattactgtgccagcagcagtacctggccactattattttttgtacttctcgtc

SEQ ID NO: 786797 - DNA, 456 bp, Homo sapiens
  misc_feature: NA.3.35.D02.1.454.heavy.3.zerom50
ttgggtttgggggaggcttggtgcagcctggggggtctctgagactctcctgtgcagcctctggagtgacctttagcaaatatggcatggcctgggtccgtcaggttccagggaaggggctggagtgggtctcggctattagtggccgtggtgaaagcatcttctacgcagactccgtgaagggccgattcaccatctccagagacaattccagggacacgctgtatctgcagatggacagcctgagagtcgaggacacggccttatattactgtgcgaaagccgtagtggcaacaacgttgtgctttgactcctggggccagggaaccctggtcgccgtctcctcagcctccaccaagggcccatcggtcytcccctggcaccctcctccaagagcacctctgggggcacagcggccctgggctgcctggtcaaggactacttccgagtgcgtct

SEQ ID NO: 786798 - DNA, 377 bp, Homo sapiens
  misc_feature: NA.40.87.H10.1.454.heavy.3.zerom50
ttgggtttggggggcctggagtgggtttcattcatgagtcatagtgggactaccatatactatgcagactcggtgaagggccgattcaccatctccagggacaacggcaagaactcactgtatctacaaatgaacagcctgagagtcgaggacacggccgtttattactgtgtgagagatcgcggcagatattgcagtagtagtagttgccctgcctactacggaatggacgtctggggccaagggaccacggtcaccgtctcttcagcctccaccaagggcccatcggtcttccccctggcgccctgctccaggagcacctccgagagcacagcggccctgggctgcctggtcaaggactacttccagtcgctaga

SEQ ID NO: 786799 - DNA, 485 bp, Homo sapiens
  misc_feature: NA.43.57.F02.1.454.heavy.3.zerom50
ttgggtttgggggaggcttgatacagccgggggggtccctgagactctcctgtgtagcctctggattcacctttaacaactatgccatgacctgggtccgccaggctccagggaaggggctggagtgggtctcagtaataagtggaagtgctggtaccacactttatgcagactccgtgatgggccggttcaccatctccagagacaattccaagaacacgctgtgtctgcaaatgaacagcctgagagccgaagacacggccgtatattactgtgcgagaggcgtcggagagtacgatattttgactggttatttgcgctactactactacgctttggacgtctggggccaagggaccacggtcaccgtctcctcagcctccaccaagggcccatcggtcttcccctggcgccctgctccaggagcacctccgagagcacagcggccctgggctgcctggtcaaggactacttccactactcac

SEQ ID NO: 786800 - DNA, 615 bp, Homo sapiens
  misc_feature: NA.5.86.H09.1.454.heavy.3.zerom50
ttgggtttgggggctctgagagaggagcccagcccctgggattttcaggtgttttcatttggtgatcaggactgaacagagagaactcaccatggagtttgggctgagcgtggckttttcttaggtggctattttaaaaggtgtccagtgtgaggtacagctgttggagtctgggggaggcttggtacagcttgggtttgggtccctgagactctcctgtgcagcctctggattcacctttactgattttggcatgacgtgggtccgccaggctccagggaaggggctggactggctctcaaatattaatggtaaaggcaatatacaagactacacagactccgtgaagggccggttcaccacctcgagagacaactccagggacacggtgtacctacacatgaacagcctgagagccgaggacacggccgtatattattgtgtgaggggaaactgggggcaatttgaccgctggggccagggaaccctggtcaccgtctcctcagcctccaccaagggcccatcggtcttccccctggcgccctgctccaggagcacctccgagagcacagcggccctgggctgcctggtcaaggactacttcccgtgtctgat

SEQ ID NO: 786801 - DNA, 466 bp, Homo sapiens
  misc_feature: NA.27.57.F02.1.454.heavy.3.zerom50
ttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctggagttcgtggccaacataaaccaagatggaggtaaagaaaactatgtggactctgtgaagggccgattcaccatctccagagacaacgccaagaagtcactgtatctgcaaatgaacagcctgagagccgaggacacggctgtatactactgtgcgagagatcctagtcattccgcttttgattcg

SEQ ID NO: 786802 - DNA, 359 bp, Homo sapiens
  misc_feature: NA.4.77.G11.1.454.heavy.3.zerom50
aagggaaaggggctggaatggctttcatacattactagcagtggtacagcatactacgcagagtctctgcagggccgattcaccatctccagggacaacgccaagaactcgctatatctggaaatgaacagcctgagagtcgaggacacggccctgtattactgtgcgagagaccgaggaagggcagtggctggatccgttagggtttttgacaactggggacagggaaccctggtcaccgtctcctcggcctccaccaagggcccatcggtcttccccctggcgccctgctccaggagcacctccgagagcacagcggccctgggctgcctggtcaaggactacttccctacagtgct

SEQ ID NO: 786803 - DNA, 449 bp, Homo sapiens
  misc_feature: NA.11.41.D08.1.454.heavy.3.zerom50
tctccgaagccttcggagaccctgtccctcacctgcactgtctctggtgactccatcagtaggtactattggagctggatccggcagcccccagggaagggactggagtggattgggtggatgtattacagtgggagcaccaactacaacccctccctcaagagtcgagtcaccatatcagtagacatgtccaagaaccagtgctccctgaagctgagctctgtgaccgctgcggacacggccgtgtattactgcgcgaaagggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 786804 - DNA, 619 bp, Homo sapiens
  misc_feature: NA.48.72.G06.1.454.heavy.3.zerom50
ctctgggagacgagcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcttgtgcagcctctggattcattttcagtgactatggtatgcactgggtccgccaggctccaggcaaggggctggagtgggtggcagtcataccttctgctggaaggaatatctactacgcgggctccgtgaagggccgattcaccatctccagagacaattccaacaagacactgtatctgcaaatgaacagcctgaggctgaagacacggctgtgtattactgtgcgagaggctatcactatggttacggggacttttcagggaaactggctcgacccctggggccagggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 786805 - DNA, 455 bp, Homo sapiens
  misc_feature: NA.53.51.E07.1.454.heavy.3.zerom50
agagaggagcccagccctgggattctcaggtgttctcatttggtgatcaggactgaacagagagaactcaccatggagtttgggctgagctggcttcttcttgtggctattttaaaaggtgtccagtgtgaggtgcaactggtggagtcggggggaggcctggtacagcctggggggtccctgagactctcctgtgcagcctctggattcacctttagcaactatggcatgagttgggtccgccagtctcctgggaaggggctggagtgggtctcaagtgttggtggtatgggtgataatccatactacgctgactccgtgaagggccggttcaccatctccagagacaattccaagaacacggtgaatctgcaaatcaacagcctgagagtcgaggacacggccgtgtattactgtgcgaaagacatgtccgaacacggtggctggtacaatgt

SEQ ID NO: 786806 - DNA, 392 bp, Homo sapiens
  misc_feature: NA.2.41.D08.1.454.heavy.3.zerom50
ctggaatatgttgcaactattactactaatgggggtagtacatattatgcaaactctgtaaagggcagattcaccatctccagagacaattccaagaacaccttatatcttcaaatgggcagcctgagagttgaggacatggctgtgtattactgtgcgagagatgggggatattgtggtggtgattgtcttttatttcgaagaagaggaaacttgggggccgactattataactacgctatggacgtctggggccaagggaccacggtcaccgtctcctcagcctccaccaagggcccatcggtcttccccctggcaccctcctccaagagcacctctgggggcacagcggccctgggctgcctggtcaaggactacttcctgtcgagcgt

SEQ ID NO: 786807 - DNA, 351 bp, Homo sapiens
  misc_feature: NA.53.60.F05.1.454.heavy.3.zerom50
gggraagggcctggagtgggtctcacatattagttgggggagtcgcagcctaggatatgcggagtctgtgaggggccggttcaccatctccagagacgacgccaggagttccttgtatctgcaaatgaacagtctgagaactgaagacacggccctctactattgtgtaaaaggggcactcggatacagcagcagttggtatgaccactggggccagggaatcctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 786808 - DNA, 445 bp, Homo sapiens
  misc_feature: NA.16.12.B01.1.454.heavy.3.zerom50
ttgggcttggaacagcctggggggtccctgagactctcctgtgcaacctctggattcacctttaccagctatgccatgagctgggtccgccaggctccagggaaggggctggagtgggtcgcagccattagtggtattcgtgatgccacatactacgcagactccgtgaggggccggttcaccatctccagcgacacttccaggagcacgttgtatctgcaaatgaacagcctgagagtcgaggacacggccctatattactgtgcgaaagataagatttggggacccgatgcttatgatagctggggccaagggacaatggtcaccgtctcttcagcctccaccaagggcccatcggtcttcccctggcaccctcctccaagagcacctctgggggcacagcggccctgggctgcctggtcaaggactacttccgagtagtaca

SEQ ID NO: 786809 - DNA, 482 bp, Homo sapiens
  misc_feature: NA.2.37.D04.1.454.heavy.3.zerom50
ttgggtttggggaagtagtccttgaccaggcagcccaggactggtgaagccttcggagaccctgtccctcacctgcactgtctctggtggctccattagtagttactactggacctggatccggcagaccccagggaagggactggagtggattgggtatgtctataacagtgggagcaccaactacaatccctccctgaagagtcgggtcaccatatcagttgacacgtccaagaaccagttctccctgaaactgaggtctgtgaccgatgcggacacggccgtatattattgtgcgagagtccctcttcagggcggctattactccggtctggacgtctggggccaagggaccacggtcaccgtctcctcagcctccaccaagggcccatcggtcttcccctggcaccctcctccaagagcacctctgggggcacagcggccctgggctgcctggtcaaggactacttcctgtcgagcgt

SEQ ID NO: 786810 - DNA, 494 bp, Homo sapiens
  misc_feature: NA.14.86.H09.1.454.heavy.3.zerom50
ttgggtttggggggaagaggaagactgacggtccccccaggagttcaggtgctgggcacggtgggcatgtgtgagttttgtcacaagatttgggctcaactctcttgtccaccttggtgttgctgggcttgtgattcacgttgcagatgtaggtctcctgtgccccaccatggacacactttgctacacactcctgctgctgacccaccccttcctgggtcttgtcccaggtcaccttgaaggagtctggtcctgtgctggtgaaacccacagagaccctcacgctgacctgcaccgtctctgggttctcactcagcaatcctagaatgggtgtgagctggatccgtcacgcccccgggaacggcccgtggagtggcttgcacactatttttcgtaatrracgtaaaaattacttacagcacatctctgaggagcagtctccaccatactcccacggaacaccctaccaacaacgccaaggtaacgtcctttaa

SEQ ID NO: 786811 - DNA, 378 bp, Homo sapiens
  misc_feature: NA.11.37.D04.1.454.heavy.3.zerom50
ttgggtgcgacaggcccctgggcaaggacttgagtggatgggacagatccacccttacactggcgacacaatttatgcacagaaatttcagggcagatttaccctgaccgaggacacggccatcaccacagtctacatggacctgaagagactgacaattaacgacacggccaaatattattgtgtcagagacaagactcaattttgtgttcgtggtcactgctggttcgacccctggggccagggaaccctgatcaccgtctcctctgcctccaccaagggcccatcggtcttccccctggcaccctcctccaagagcacctctgggggcacagcggccctgggctgcctggtcaaggactacttccgtatctctcg

SEQ ID NO: 786812 - DNA, 481 bp, Homo sapiens
  misc_feature: NA.7.70.G04.1.454.heavy.3.zerom50
tctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgtgggggttcgaccccgtggggccaggggaaccctggtcaccgtctcctcacgcctccaaccgg

SEQ ID NO: 786813 - DNA, 486 bp, Homo sapiens
  misc_feature: NA.13.28.C06.1.454.heavy.3.zerom50
aggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgccaggctccagggaaggggctggagtgggtggccaacataaagtacgatgaagttgagataaattatttggactctgtgaagggccgattcaccatctcgagggacaacgccaagaactcgctgtatctgcaaatggagagcctgagagccgaggacacggctgtatattattgtgtgagattagcgcactactttgactacgtggggccaggggaaccctggtccaccggttcccg

SEQ ID NO: 786814 - DNA, 605 bp, Homo sapiens
  misc_feature: NA.9.36.D03.1.454.heavy.3.zerom50
atctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctggatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtcaaggactacttccagacgtatca

SEQ ID NO: 786815 - DNA, 474 bp, Homo sapiens
  misc_feature: NA.53.83.H06.1.454.heavy.3.zerom50
tcgcgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcggggggacgcgtggtccagcctgggaggtccctgagactctcctgtgtagcctctggatttaccttcagggtctatgacatgcactgggtccgccaggctccaggcaaggggctggagtgggtggcacttatctcacatgatggaaataaaaaaactataggtgactccgtgaagggccgattctccgtctccagagacaattccaagaacaccttgtatctgcaaatgaacagcctgagatatgaggacacggctctgtattactgtgcgaaagaaaggttactgtggaagagtgggagttagttcgtta

SEQ ID NO: 786816 - DNA, 462 bp, Homo sapiens
  misc_feature: NA.40.61.F06.1.454.heavy.3.zerom50
agctctgggagaggagccccagccctgagattcccatgtgtttccattcagtgatcagcactgcacacagaggactcgccatggagtttgggctgagctgggttttccttgttgctattttaaaaggtgtccagtgtgaagtgcacctggtggaatgggtctctgctattaattggaatggcggtagtggacattatgcagactctgtgaggggccgtttcaccatctccagagacaacgccaagaactccctgtatctgcaaatgaacagtctgaaagtcgaggacacggccttctattactgtgtgagagatgggatgtggcacctgtccctccacacaaattggggccagggaaccctggtcaccgtctcctcagcctccaccaagggcccatcggtccttcccctggccaccctcctccaagagcacctctgggggcacagcggccctgggctgcctc

SEQ ID NO: 786817 - DNA, 443 bp, Homo sapiens
  misc_feature: NA.51.25.C03.2.454.heavy.3.zerom50
aggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 786818 - DNA, 482 bp, Homo sapiens
  misc_feature: NA.40.53.E09.3.454.heavy.3.zerom50
ttgggtttgggtgctcgatttagagtgagctcgttgggtttgggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgccaagaacacagtgtctctgcaaatggacagtctgagagccgaggacacgggtgtctattattgtacaaaagtggggactaatgaatatggtgtggacgtctggggccaagggaccacggtcgtcgcctcttatgcctccaccaagggcccatcggtcttcccctggcgccctgctccaggagcacctccgagaggcacagcggccctgggctgcctggtcaaggactacttccagtcgctaga

SEQ ID NO: 786819 - DNA, 459 bp, Homo sapiens; identical to SEQ ID NO: 785976
  misc_feature: NA.14.12.B01.1.454.heavy.3.zerom50

SEQ ID NO: 786820 - DNA, 504 bp, Homo sapiens
  misc_feature: NA.51.58.F03.1.454.heavy.3.zerom50
aagggaaagggggctaagggaaaggggggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcactgtctctggtggctccatcagcagcagtagttacttctggggctggatccgccagcccccagggaagggactggagtggatagggaatgtccattatagtgggagcacctactacaatccgtccctcaacagtcgagtcaccatatccgttgacacgtccaagaaccaattcttcctgaggctgacctctgtgaccgccgcagatacggcagtttattactgtgcaagaaagaactaccttgaaaactggggccacggaaccctggtcaccgtctcctcagcctccaccaagggcccatcggtccttccccctggccaccctcctccaagacg

SEQ ID NO: 786821 - DNA, 494 bp, Homo sapiens
  misc_feature: NA.13.6.A06.1.454.heavy.3.zerom50
agggtctccgaaggcttcaccagtcctgtcccaggtgcagctgcgggagtcgggcccaggactggtgaagccttcggagaccctgtccctcacctgcactgtctctggtggctccatcagtagttactactggagctggatccggcagcccccagggaagggactggagtggattgggcatatcttttacagtgggagcaccaactacaacccctccctcaagagtcgagtcaccatatcagtggacacgtccaagaaccagttctccctgaagctgagctctgtgaccgctgcggacacggccgtgtattactgtgcgagctggggttcagggtactttgactactggggccagggaaccctggtcaccgtctcctcagcctccaccaagggcccatcggtcttccccctggccaccctcctccaagacgcacctctgggggcacagcggccctgggctgcctggtcaaggactacttcctagtacgtgtacg

SEQ ID NO: 786822 - DNA, 458 bp, Homo sapiens
  misc_feature: NA.49.61.F06.3.454.heavy.3.zerom50
tctgtgaagccttcacagaccctgtccctcacctgcgctgtctctggtggctccatcaccagtggtggttattcctggacttggatccggcagccaccagggaaggccctggagtggattgggcacatctatcatagtgggaccacctactacaacccgtccctccagagtcgagtcaccatatcagtcgacatgtccgagaaccagttctccctgtacctccactctgtgaccgccgcggacacggccgtctattactgtgccagaggggaactctacttcggggagttaggaatcgctcctgcatttgacatctggggccagggaaacctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 786823 - DNA, 558 bp, Homo sapiens
  misc_feature: NA.53.41.D08.5.454.heavy.3.zerom50
cacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggtttttggactggttctcccatggaatccctactttgagtactggggccgcggagccctggtcaccgtctcctcagcctccaccaagggcccatcggtcttccccctggccaccctcctccaagagcacctctgggggcacagcggccctgggctgcctggtcaaggactacttcctcgtactgcg

SEQ ID NO: 786824 - DNA, 447 bp, Homo sapiens
  misc_feature: NA.4.6.A06.1.454.heavy.3.zerom50
agggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctccctcaagagtcgactcaccatctcggctgacccgtccaagaatcagttctccctgaggctgacctctgtgaccgccgctgacacggccgtctattactgtgggagacagtgcagtggtggttcgtgccccgagtactggggccgcggaatcttggtcaccgtctcctcagcctccaccaagggcccatcggtcttcccctggcgccctgctccaggagcacctccgagagcacagcggccctgggctgcctggtcaaggactacttccctacagtgct

SEQ ID NO: 786825 - DNA, 463 bp, Homo sapiens
  misc_feature: NA.17.74.G08.1.454.heavy.3.zerom50
agggtcttcgtggctcacgtccaccaccacgcatgtgacctcaggggtccctgagactctcctgtgcagcctctggattcaccttcagtacctactggatgcactgggtccgccaagctccagggaaggggctggagtggctctcacgtgttgataatgttggcagtttcacaaaatacgcggactccgtgaagggccgattcaccatctccagagacaacgccaagaacacgctgtatctgcaaatgaacagtctgagagccgaggacacggctgtttattactgtgcaagacagcactacagtcactacttcgacccctggggccagggaaccctggtcaccgtctcctcagcctccaccaagggcccatcggtcttccccctggcaccctcctccaagagcacctctgggggcacagcggccctgggctgcctggtcaaggactacttccctagtctacg

SEQ ID NO: 786826 - DNA, 629 bp, Homo sapiens
  misc_feature: NA.52.26.C04.3.454.heavy.3.zerom50
aggtctcggagaggagccttagccctggactccaaggcctttccacttggtgatcagcactgagcacagaggactcaccatggagttggggctgagctgggttttccttgttgctattttagaaggtgtccagtgtgaggcgcaggctggtggaggtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttcccctggcaccctcctccaagagcacctctgggggcacagcggccctgggctgcctggtcaaggactacttcctatacgac

SEQ ID NO: 786827 - DNA, 584 bp, Homo sapiens
  misc_feature: NA.49.70.G04.1.454.heavy.3.zerom50
ctgggagaggagcccagcactgggattccgaggtgtttccattcagtgatctgcactgaacacagaggactcgccatggaatttgggctgagctgggttttccttgttgctattataaaaggtgtccagtgtgaggtgcaactggtgcagtctgggggaggcttggtccagcctgggatttccctgagactctcctgtgcagcctctggagtcaccgtcagcaacaactacatgagctgggtccgccaggctccaggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 786828 - DNA, 564 bp, Homo sapiens
  misc_feature: NA.53.37.D04.1.454.heavy.3.zerom50
ttgggtttggggggaagaggaagactgacggtcctcccaggagttcaggtgctgggcaccttgggtttgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaagggcccatcggtcttcccctggcgccctgctccaggagcaccctcgtgggggycgacgacgccggccccgtcggggcgtcggccctcgggtycaaagggaccgttaaccttycycktmcgttaaccttcggtcc

SEQ ID NO: 786829 - DNA, 478 bp, Homo sapiens
  misc_feature: NA.51.68.G02.5.454.heavy.3.zerom50
cagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatttcatatgatggaagtaaaatattctatgtagactccgtgaagggccgcttcatcatctccagagacaattcccagaacaccctgtttctgcaaatgcacagcctgagacctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcgscctgggctgcctggtcaaggactacttcctcgtagcact

SEQ ID NO: 786830 - DNA, 344 bp, Homo sapiens; identical to SEQ ID NO: 786736
  misc_feature: NA.47.45.E01.2.454.heavy.3.zerom50

SEQ ID NO: 786831 - DNA, 373 bp, Homo sapiens
  misc_feature: NA.13.30.C08.1.454.heavy.3.zerom50
aagggaaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagttttccagacggcgactacgttgtcggctggggcgactttgacatttggggccaagggacactggtcaccgtctcccaagcttccaccaagggcccatcggtcttccccctggcgccctgctccaggagcacctctgggggcacagcggccctgggctgcctggtcaaggactacttcctagtackwgacg

SEQ ID NO: 786832 - DNA, 344 bp, Homo sapiens; identical to SEQ ID NO: 786586
  misc_feature: NA.51.70.G04.4.454.heavy.3.zerom50

SEQ ID NO: 786833 - DNA, 391 bp, Homo sapiens
  misc_feature: NA.53.65.F10.1.454.heavy.3.zerom50
agggagtagagtcctgaggactgtaggctcccgggaaggggctggagtgggtctcaggtattagtggcagtggtggaatcacatactacgcagactccgtgaagggccggttcaccatctccagagacaactccaagaacacactgtttctacaaatgaatagcctgagagccgcggacacggccgtatattattgtgcgaaagtttgggggtggcaattggagtggtttttagatccgattgactactggggcctgggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 786834 - DNA, 349 bp, Homo sapiens
  misc_feature: NA.16.17.B06.1.454.heavy.3.zerom50
agggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 786835 - DNA, 272 bp, Homo sapiens
  misc_feature: NA.49.76.G10.2.454.heavy.3.zerom50
agggacaattccgagaacacgctgtatctgcaaatgaacagcctgagagctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctctctcgact

SEQ ID NO: 786836 - DNA, 318 bp, Homo sapiens
  misc_feature: NA.14.39.D06.1.454.heavy.3.zerom50
cagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgtactagacg

SEQ ID NO: 786837 - DNA, 399 bp, Homo sapiens
  misc_feature: NA.53.28.C06.4.454.heavy.3.zerom50
ctcggggctgccctttggctttggagatggttttctcgatgggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctcccaagagcacctctgggggcacagcggccctgggctgcctggtcaaggactacttcctcgtactgcg

SEQ ID NO: 786838 - DNA, 363 bp, Homo sapiens; identical to SEQ ID NO: 786440
  misc_feature: NA.51.61.F06.2.454.heavy.3.zerom50

SEQ ID NO: 786839 - DNA, 347 bp, Homo sapiens
  misc_feature: NA.40.28.C06.2.454.heavy.3.zerom50
tgcccaagctgctggagtggattgggagtatgcactatagtgggagcacccactacaccccgtccctcaagagtcgagtcaccatatccgtagacacgtccaaggaatcagttctcccctgaagctgacctctgtgaccgccggcagacacggctgtttattactgtgtgagacgggtgccccaagaaaaagtgttttatccctggggccagggaaccctggtcaccgtctcctcagcctccaccaagggcccatcggtcttccccctggcaccctcctccaagagcacctctgggggcacagcggcccgtgggctgcctggtcaaggactacttccagtcgctaga

SEQ ID NO: 786840 - DNA, 318 bp, Homo sapiens
  misc_feature: NA.11.12.B01.2.454.heavy.3.zerom50
ttgggttttccttgttgctattttaaaagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgtatctctcg

SEQ ID NO: 786841 - DNA, 373 bp, Homo sapiens
  misc_feature: NA.51.42.D09.1.454.heavy.3.zerom50
agggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 786842 - DNA, 642 bp, Homo sapiens
  misc_feature: NA.48.56.F01.3.454.heavy.3.zerom50
aacacacaaagggggtctcagagaggagccttagccctggactccaaggcctttccacttggtgatcagcactgagcacagaggactcaccatggaattggggctgagctggggttttccttgttgctattttagaaggtgtccagtgtgaggtgcagctggtggagtctgggggaggcttggtccagccgggggggtccctgagactctcctgtgcagcctctggactcacctttagtacctattggatgacctgggtccgccaatctccagggagggggctggagtgggtggcmacacayaaagggagatggaagtaagacatactatgcggattctgtgaagggccgattcaccatctccagagacaacgccaaggaggtcactgtatctgcagatgaacagcctgagaggccgaggacggcgggctgtgtattactgtgcgagagatgtgaatccctttgatagtagtggtcgttactatgatgctttggatatgtggggccaagggacaacggtcaccgtctcttcagcctccaccaagggcccatcggtcttccccctggcgccctgctccaggagcacctccgagagcacagcggccctgggctgcctggtcaaggactacttcctatgtatact

SEQ ID NO: 786843 - DNA, 347 bp, Homo sapiens
  misc_feature: NA.11.20.B09.1.454.heavy.3.zerom50
aaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaagggcccatcggtcttccccctggcaccctcctccaagagcacctctgggggcacagcggccctgggctgcctggtcaaggactacttccgtatctctcg

SEQ ID NO: 786844 - DNA, 345 bp, Homo sapiens
  misc_feature: NA.13.70.G04.2.454.heavy.3.zerom50
cctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagatccaaccccttacgatttttggagtggttataccgagtggggccagggaaccctggtcatcgtctcctcagcctccaccaagggcccatcggtcttccccctggcaccctcctccaagagcacctctgggggcacagcggccctgggctgcctggtcaaggactacttcctagtacgtga

SEQ ID NO: 786845 - DNA, 596 bp, Homo sapiens
  misc_feature: NA.47.55.E11.1.454.heavy.3.multim50
ttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgtggggccagggtaacccgtcagcgtctcctcagcctccaccaagggcccatcggtcttcccctggcgccctgctccaggagcacctccgagagcacagcggccctgggctgcctggtcaaggactacttcctacgtgagct

SEQ ID NO: 786846 - DNA, 478 bp, Homo sapiens
  misc_feature: NA.49.42.D09.2.454.heavy.3.multim50
agggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaagccgggggggtccctgagactctcctgtgcagcctctggattcaccttccgttcctataccatgaactggatccgccaggctccagggaggcgactggagtgggtctcatctattagtggtagaggtgattactacaactacgcagactcactggagggccgattcaccatctccagagacaacaccaagaatttactgtatctgcaaatggacagcctgagagccgacgacacggctgtctattactgtgcgagagttcgggatattgccgtagtcccagatgtcccgaacc

SEQ ID NO: 786847 - DNA, 620 bp, Homo sapiens
  misc_feature: NA.51.15.B04.1.454.heavy.3.multim50
tccgcggggaggtctcagagaggagccttagccctggactccaaggcctttccacttggtgatcagcactgagcacagaggactcaccatggagttggggctgagctgggttttccttgttgctattttagaaggtgtccaatgtgaggtgcacctggtggagtctgggggaggcttggtccagccgggggggtccctgagactctcctgtagagcctctggattcacctttagtaacttctggatgagctgggtccgccaggctccagggaaggggctggagtgggtggccaacataaacaaagatggaggtgagaagtactatgtggactctgtgaagggccgattcaccgtctccagagacaacgccaagaactcactgtatctgcaaatgaacagcctgagaaccagggacacggccctgtattactgtgcgagacacgggtcaaaacaactttggttacgggaaagactcctggggccaggggaccctggtcaccgtctcctcagcctccaccaagggcccatcggtcttcccctggcaccctcctccaagagcacctctgggggcacagcggccctgggctgcctggtcaaggactacttcctcgtagcactcg

SEQ ID NO: 786848 - DNA, 442 bp, Homo sapiens
  misc_feature: NA.49.42.D09.4.454.heavy.3.multim50
  modified_base (437)..(437): a, c, t, g, unknown or other
agggaaagggggctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatactgcaaatgaacaggctgagagctgaagacacrgkctttatattactgtncgact

SEQ ID NO: 786849 - DNA, 575 bp, Homo sapiens
  misc_feature: NA.49.28.C06.1.454.heavy.3.multim50
agctctgggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagacttttatgacagtagtggtttctccgagtatgcacattacggcatggacgtctggggccaagggaccccggtcaccgtctccttagcctccaccaaggcccatcggtcttccccctggccaccctcctccaagagcacctctc

SEQ ID NO: 786850 - DNA, 513 bp, Homo sapiens
  misc_feature: NA.49.28.C06.3.454.heavy.3.multim50
aagaggaagactgacggtcctcccaggagttcaggtgctgggcaccgtgggcatgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctgggggccagggagccctggtcaccgtctcctcagcttccaccagggcccatcggtccttcccctcggcgccctgctccaggagcacctctgggggcacagcggcctgggctgcctggtcaaggactactcctctctcgta

SEQ ID NO: 786851 - DNA, 539 bp, Homo sapiens
  misc_feature: NA.49.28.C06.4.454.heavy.3.multim50
acccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccaggggaaccccggtcaccgtctcctctcgcctccaccaasgcccatcggtcttcccctggcaccctcctccaagagcacctctgggggcacgagcggccctgg

SEQ ID NO: 786852 - DNA, 582 bp, Homo sapiens
  misc_feature: NA.40.34.D01.1.454.heavy.3.multim50
ttgggtttgggggagtctccctcactgcccagctgggatctcagggcttcattttctgtcctccaccatcatgggggcaaccgccatcctcgccctcctcctggctgttgtccaaggagtctgtgccgaggtgcagctggtgcagtctggagcagaggtgaaaaagcccggggagtctctgaagatctcctgtttgggtttgggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaagggcccatcggtcttccccctggcgccctgctccaggagcacctctgggggcacagcggccctgggctgcctggtcaaggactacttccagtcgctaga

SEQ ID NO: 786853 - DNA, 457 bp, Homo sapiens
  misc_feature: NA.53.38.D05.1.454.heavy.3.multim50
tttgggtttggggacccaacaaccacatccctcctcagaagcccccagagcacaacgcctcaccatggactggacctggaggatcctctttttggtggcagcagccacaggtgcccactcccaggtccagcttgtgcagtctggggctgaggcgaagaagcctggggcctcagtgaaggtttcctgccaggcttctggatacaccctcagtacccatgctatccattgggtgcgccaggcccccggacaaagacttgagtggatgggatggatcagcgctggcaatggtgacagacactattcacagaagttccagggcagagtcaccatcaccagggacacatccgcgagcacagcctacatggaactgagcagcctgagatctgaagacacgggtgtatattactgtgcgagagggaagtgggatattgtagatgcgccaggtgccccggcccgk

SEQ ID NO: 786854 - DNA, 634 bp, Homo sapiens
  misc_feature: NA.48.77.G11.1.454.heavy.3.multim50
gaaagggaaaggggctctgggagacgagcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcttgtgcagcctctggattcattttcagtgactatggtatgcactgggtccgccaggctccaggcaaggggctggagtgggtggcagtcataccttctgctggaaggaatatctactacgcgggctccgtgaagggccgattcaccatctccagagacaattccaacaagacactgtatctgcaaatgaacagcctgagggctgaagacacggctgtgtattactgtgcgagaggctatcactatgggttcacggacttttcagggaaactggctcgacccctggggccagggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 786855 - DNA, 489 bp, Homo sapiens
  misc_feature: NA.12.40.D07.1.454.heavy.3.multim50
taacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggccgccctcgt

SEQ ID NO: 786856 - DNA, 545 bp, Homo sapiens
  misc_feature: NA.49.28.C06.8.454.heavy.3.multim50
tctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgaccctggggccagggagccctggtcaccgtctcctcagcttccaccaagggcccatcggtccttcccctggccgtccc

SEQ ID NO: 786857 - DNA, 488 bp, Homo sapiens
  misc_feature: NA.13.33.C11.2.454.heavy.3.multim50
ttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactacgtggggccagggaaccctggtcaccgtctcctcagcctccaccaaggggaccccg

SEQ ID NO: 786858 - DNA, 327 bp, Homo sapiens
  misc_feature: NA.13.23.C01.2.454.heavy.3.multim50
tagggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactactggggccagggaaccctggtcaccgtctcctcagcctccaccaagggcccatcggtcttccccctggcaccctcctccaagagcacctctggggcacagcggccctgggctgcctggtcaaggactacttcctagtacgtga

SEQ ID NO: 786859 - DNA, 565 bp, Homo sapiens
  misc_feature: NA.51.26.C04.1.454.heavy.3.multim50
agctctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatcggtcttccccctggccaccctcctccaagagcacctctc

SEQ ID NO: 786860 - DNA, 516 bp, Homo sapiens
  misc_feature: NA.16.37.D04.1.454.heavy.3.multim50
tgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaaggactacttccgagtagtacagttaccggtaagttacgtaactacgtaggacgggccgggtcggtcggaacggacggcgact

SEQ ID NO: 786861 - DNA, 470 bp, Homo sapiens
  misc_feature: NA.48.57.F02.3.454.heavy.3.multim50
ttgggtttggggggtctcagagaggagccttagccctggactccaaggcctttccacttggtgatcagcactgagcacagaggactcaccatggaattggggctgagctgggttttccttgttgctattttagaaggtgtccagtgtgaagtgcagctggtggagtctgggggaggcttggtccagcctggggggtccctaagactctcctgtgcagcctctggattcacctttagtacctattggatgacctggatgaacagcctgagagccgaggacgcggctgtgtattactgtgcgagagatgcgaatccctctgatagtaatggtcgttattatgatgcttttgatatgtggggccaagggacaacggtcaccgtctcttcagcctccaccaagggcccatcggtcttcccctggcgccctgctccaggagcacctccgagagcacagcggccctgggctgtccg

SEQ ID NO: 786862 - DNA, 640 bp, Homo sapiens
  misc_feature: NA.48.59.F04.1.454.heavy.3.multim50
twgggattggggcagggtgtacacctgtggttctcggggctgccctttggctttggagatagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccgaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 786863 - DNA, 481 bp, Homo sapiens
  misc_feature: NA.48.57.F02.6.454.heavy.3.multim50
ttgggtttggggacccaacaaccacacccctcctaagaagaagcccctagaccacagctccacaccatggactggacctggaggatcctcttcttggtggcagcagcaacaggtgcccactcccaggtgcagttggtgcaatctgggtctgatttgaagaagcctggggcctcagtgaaggtttcctgcagggcttctggatactccttcactgactatggtatcaattgggtgcgacaggcccctggccaagggcttgagtggatggggtggatcgacaccaacactgggaacccaacacatgcccggggcttcaaaggacggtttgacttctccttggccacctctgtcagcacggcatatctgcagatcagcagcctaaagcctagaggacactgccgtgttttattgtgcgagatccaaggcgaggaggataccggattcgttatatagcgactactactacttcggaatggtaccg

SEQ ID NO: 786864 - DNA, 588 bp, Homo sapiens
  misc_feature: NA.18.33.C11.1.454.heavy.3.multim50
tttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaacccgggcccatcggtcttcccctggcaccctcctccaagagcacctctgggggcacagcggccctgggctgcctggtcaaggactacttcccatactcgta

SEQ ID NO: 786865 - DNA, 480 bp, Homo sapiens
  misc_feature: NA.16.10.A10.1.454.heavy.3.multim50
agggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtagtacacg

SEQ ID NO: 786866 - DNA, 463 bp, Homo sapiens
  misc_feature: NA.52.33.C11.3.454.heavy.3.multim50
ttgggttggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaaggtttgagtggatgggatggatcaccgctggcaatggtgacacaaaatattcacagaagttccagggcagagtcaccattaacagggacacatctgcgagtacaggctacatggaactgagcggcctgagatctgaggacacggctatttattactgtgcgagagggaagtgggatattgtggcagctccaggtgcccagcccggccccttacg

SEQ ID NO: 786867 - DNA, 483 bp, Homo sapiens
  misc_feature: NA.49.87.H10.2.454.heavy.3.multim50
ttgggtttgggggctctgggagaggagcccagcactagaagtcggcggtgtttccattcggtgatcagcactgaacacagaggactcaccatggagtttgggctgagctgggttttcctcgttgctcttttaagaggtgtccattgtcaggtgcagttaatggagtcggggggatctgtggtccggcctgggaggtccctgagactctcctgtgcagcctccggattcaacttcgggaactatggcttacactgggtccgccaggctccaggcaaggggctggagtgggtggcagttatttcatatgattcaagtattggatattacgcagagtccgttaagggccgattcaccatctccagagacaattccaagaacaccctgtatctgcaattgaacagactcagagctgaggacacggctgtgtattattgtgtgaargacgtttatgagagtaatggttttccgagtatgcatagttac

SEQ ID NO: 786868 - DNA, 481 bp, Homo sapiens
  misc_feature: NA.49.87.H10.3.454.heavy.3.multim50
ttgggtttggggttgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttaatccracgggaggaccgaacggtcgacccccgtccgtccg

SEQ ID NO: 786869 - DNA, 473 bp, Homo sapiens
  misc_feature: NA.49.87.H10.4.454.heavy.3.multim50
ttgggtttggggcstgggagaggagcccagcactgggattccgaggtgtttccattcagtgatctgcactgaacacagaggactcgccatggagtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatccccgggtatagcagtgtctggtacatattactc

SEQ ID NO: 786870 - DNA, 662 bp, Homo sapiens
  misc_feature: NA.4.57.F02.1.454.heavy.3.multim50
ttgggtttggggctgggagaggagcccaccagcactagaagtcggcggtgtttccattcggtgatcaccactgaacacagaggactcaccattgggtttggggggaagaggaagactgacggtcctcccaggagttcaggtgtctggtgcacctggtggagtatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctcgtgggggcacgagccggccccgggctgcctggtcaaggactacttccctacagtgctaaccgtacctttaccccttaccaaggtcggtctccttcggaggcggggccgtt

SEQ ID NO: 786871 - DNA, 533 bp, Homo sapiens
  misc_feature: NA.49.87.H10.6.454.heavy.3.multim50
ttgggtttggggggaagaggaagactgacggtcctcccaggagttcaggtgctgggcaccktgggyytgggggaggcgtggyccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgtaccccgtggggccagggagccctggtcaccgtctcctcagcttccaccaagggcccatcggtccttccccctggccgccctcgctcccaggagcacctctgggggcacagcggccctgggctgcctggtcaaggactacttctctctcgta

SEQ ID NO: 786872 - DNA, 607 bp, Homo sapiens
  misc_feature: NA.13.86.H09.1.454.heavy.3.multim50
ttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaattactacttaacatggacgtctggggcaaasggacgacggtcaccgtttcgccagcctccaccaagggcccatcggtcttccccctggcaccctcctccaagagcacctctgggggcacagcggccctgggctgcctggtcaaggactacttcctagtacgtga

SEQ ID NO: 786873 - DNA, 579 bp, Homo sapiens
  misc_feature: NA.49.87.H10.9.454.heavy.3.multim50
  modified_base (467)..(467): a, c, t, g, unknown or other
ttgggtttggggtctgggagacgagcccagcactggaagtcgccggtgtttccattcggtgatcatcactgaacacagaggactcaccatkgrgtttgggctgagctgggttttcctcgttgctcttttaagaggtgtccagtgtcatgtgcagttgatacagtctggggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttacaaatgaacactctgagacgtgaggacacggctgtctattactgtgcgactgagatgtctttattacgatgccagtncgtttagtaccgttcgacccctggggtccgagggagcccgtggtccaccgtctccttcgagcttccacccaacggggcccacgttcggtcctttccccctcggccgtccccg

SEQ ID NO: 786874 - DNA, 350 bp, Homo sapiens
  misc_feature: NA.13.62.F07.1.454.heavy.3.multim50
aagggaaagggcctggagtggattgggtacatctattacagtgggactacctactataatccgtccctcacgagtcgagtgaccatatcagtagacacgtctgagaaccagttctccctgaaactgagttctgtgactgccgcggacacggccgtgtattattgtgcgagaggtcgagtggatggttcagggagttcttttgactactggggccagggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 786875 - DNA, 338 bp, Homo sapiens
  misc_feature: NA.47.77.G11.1.454.heavy.3.multim50
aagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 786876 - DNA, 490 bp, Homo sapiens
  misc_feature: NA.52.5.A05.1.454.heavy.3.multim50
agggggctctgggaaaggagccccagccctgagattcccaggtgtttccattcggtgatcagcactgaacacagaactcaccatggagtttggactgagctgggttttccttgttgctattttaaaaggtgtccaggctgaagtgcagctggtggaatctgggggaatcgtggtgcggcctggggggtccctgagactctcctgttcagccgctggattcacgtttgatgattatgccatgtactgggtccgtcaagctccggggaagggtctggagtgggtctctcttgtgaattgggatggcagtgcttcttattacgccgactctgtgaagggtcggttcaccatctccagagacaacagaaaaactccctatatcttcaaatgagaagtctgagaattgaggacaccgccttatattactgcgctaaaggccttgacgcgttggctataaatggattggaccactggggccagggaacccacgtcc

SEQ ID NO: 786877 - DNA, 514 bp, Homo sapiens
  misc_feature: NA.52.5.A05.3.454.heavy.3.multim50
agggggggggcaatttataaacccaaaaggacatggccatgcagcgggtagggacaatacagacagatatcagcctgaaatgtagcctcagggcacaggtgggcacgggcactgtccacctaagccaggggcagacccgagtgtccccgcagtagacctgagagcgctgggcccacagcctcccctcggtgccctgctacctcctcaggtcagccctgggcatcccgggtttccccagtcctggcggtaggtttggggtgaagtctgtgtcactgtggtatttcgatttttggagtggttatttccttcctactactttgattattggggccagggaaccctggtctccttctcctcaatgctacgatctggacgtctggggccaagggaccacggtcaccgtctcctcagcctccaccaagggcccatcggtcttccccctcggcaccctcctccaagagcacctctgggggcacagcggccctgggctgcctggtcaaggactacttcctac

SEQ ID NO: 786878 - DNA, 457 bp, Homo sapiens
  misc_feature: NA.49.35.D02.6.454.heavy.3.multim50
ttgggtttggggatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgaacacagcctacatggaactgcgcagcctaggatctgccgacacggccgtatatttctgtgcgagagagatgtctttctatgatagtactagtcatttatgt

SEQ ID NO: 786879 - DNA, 485 bp, Homo sapiens
  misc_feature: NA.49.35.D02.3.454.heavy.3.multim50
ttgggtttggggctctgggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagacttttatgacagtagtggtttctccgagtatgcacacttacgg

SEQ ID NO: 786880 - DNA, 489 bp, Homo sapiens
  misc_feature: NA.49.35.D02.4.454.heavy.3.multim50
ttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggattttggacttacgtvggggccaggggaaccccggtcacccgtctccctctgcctccc

SEQ ID NO: 786881 - DNA, 627 bp, Homo sapiens
  misc_feature: NA.49.35.D02.7.454.heavy.3.multim50
ttgggtttgggacgktgkkttygagskctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgacaaaagattacggtgaccacacctattttagaccactgcggccagggaaccctagtcaccgtctcctcagcctccaccaagggcccatcggtcttccccctggcaccctcctccaagagcacctctgggggcacagcggccctgggctgcctggtcaaggactacttcctctctcgact

SEQ ID NO: 786882 - DNA, 444 bp, Homo sapiens
  misc_feature: NA.49.35.D02.8.454.heavy.3.multim50
ttgggtttggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcmaatgaacaggctgagagctgaagacacggctgtatattactgtsgcgaacttaa

SEQ ID NO: 786883 - DNA, 331 bp, Homo sapiens
  misc_feature: NA.49.29.C07.4.454.heavy.3.multim50
agggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 786884 - DNA, 484 bp, Homo sapiens
  misc_feature: NA.49.35.D02.10.454.heavy.3.multim50
ttgggtttggggttgaagtgaagaagcctggggcctcggtgaaggtttcctgcaaggcatctggatacagcttgaccaactactatatacagtgggtgcgacaggcccctggacaagggcttgagtggatgggaagaatcaaccctaatgatggaagtacaacaaacgcgcagaaatttcagggcagaataaccctgaccagggacacgtccacgagcacagtctacatggaattgagcagcctgagatctgaagacacggccgtctattactgtgccagagaatatcgttttatagtgggagctgccccacgatcgccattccactttgactactggggccagggaacactggtcaccgtctcctcagcctccaccaagggcccatcggtctttccccctgrccaccctcctcccaagagcacctcctgggggcacagccggccctgggctgcctggtcaaggacctacttcctctctcgact

SEQ ID NO: 786885 - DNA, 473 bp, Homo sapiens
  misc_feature: NA.48.27.C05.1.454.heavy.3.multim50
agggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactatggttcggggagtcgtccgacccagcaactggttcgkaccccg

SEQ ID NO: 786886 - DNA, 451 bp, Homo sapiens
  misc_feature: NA.48.27.C05.8.454.heavy.3.multim50
agggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagaataatcggckwgaataaagatatrsaa

SEQ ID NO: 786887 - DNA, 325 bp, Homo sapiens
  misc_feature: NA.13.42.D09.6.454.heavy.3.multim50
agggaaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggcccatcggtcttccccctggcgccctgctccaggagcacctccgagagcacagcggccctgggctgcctggtcaaggactacttccgtactagacg

SEQ ID NO: 786888 - DNA, 351 bp, Homo sapiens
  misc_feature: NA.13.42.D09.7.454.heavy.3.multim50
agggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgtgagagatcgagatgtgtcatcgcggggcacttttgatatctggggccaagggtcgatggtcatcgtctcttcagcctccaccaagggcccatcggtcttccccctggcgccctgctccaggagcacctccgagagcacagcggccctgggctgcctggtcaaggactacttcctagtacgtgacg

SEQ ID NO: 786889 - DNA, 457 bp, Homo sapiens
  misc_feature: NA.48.30.C08.1.454.heavy.3.multim50
aagggaaaggggagcatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaagcctggggcctcagtgaagatttcctgcaaggcatctggatacatcttcaccacctacaatatacactgggtgcgacaggcccctcgacaagggcctgagtggatggggatgatcaaccctaggtatggcagcacaagccacgcagagaagttccagggcagagttatcatgaccagcgacacgtccacgagcacagtctacatgagtctgagcagcctgagatctgaagacacggccgtctattactgtgcgaggagggggggtgggtacccraggtaccgtaaacgg

SEQ ID NO: 786890 - DNA, 352 bp, Homo sapiens
  misc_feature: NA.13.42.D09.1.454.heavy.3.multim50
agggaaaggcatacgcagggaaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttggggccggggaaccctggtcaccgtcaactcagcctccaccaagggcccatcggtcttccccctggcgccctgctccaggagcacctccgagagcacagcggccctgggctgcctggtcaaggactacttcctagtacgtgacg

SEQ ID NO: 786891 - DNA, 621 bp, Homo sapiens
  misc_feature: NA.48.30.C08.3.454.heavy.3.multim50
aagggaaaggggtctgagagaggagccttagccctggattccaaggcctatccacttggtgatcagcactgagcaccgaggattcaccatggaactggggctccgctgggttatccttgttgctattttagaaggtgtccagtgtgaggtgcagctggtggagtcagggggaggcctggtcaagcctggggggtccctgagactctcctgtgcagcctctggattcaccttcagtacctataccatgaactgggtccgccaggctccagggaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctacgtgttccactttgactactggggccagggaaccctggtcaccgtctcctcagcctccaccaagggcccatcggtcttccccctggcaccctcctccaagagcacctctggggcacagcggccctgggctgcctggtcaaggactacttcctatgtatact

SEQ ID NO: 786892 - DNA, 617 bp, Homo sapiens
  misc_feature: NA.48.30.C08.4.454.heavy.3.multim50
aagggaaagggggggagaggagccccagccttggaattcccaagtgttttcattmagkgatmaggaskgaacacagaggactcaccatggagtttgggctgagctggattttccttgctgctattttaaaaggtgtccagtgtgaggtgcagctggtgcagtccggggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaacgggcccatcggtcttccccctcggccgccctcgctccaggagcacctccgagagcacagcggccctgggctgcctggtcaaggactacttcctatgtatact

SEQ ID NO: 786893 - DNA, 496 bp, Homo sapiens
  misc_feature: NA.18.78.H01.1.454.heavy.3.multim50
ctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacagtttggggggtagttagtcgacgaaacgggggggtacgtacgtacgtacg

SEQ ID NO: 786894 - DNA, 486 bp, Homo sapiens
  misc_feature: NA.18.78.H01.2.454.heavy.3.multim50
ctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctctggggccaaac

SEQ ID NO: 786895 - DNA, 487 bp, Homo sapiens
  misc_feature: NA.18.78.H01.3.454.heavy.3.multim50
ctgggagaggagctccagccttgggattcccagctgtctccactcggtgatcggcactgaatacaggagactcaccatggagtttgggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggggccggggaacccgtggtcaccgtctcccctaccctcccacccgaac

SEQ ID NO: 786896 - DNA, 445 bp, Homo sapiens
  misc_feature: NA.49.33.C11.3.454.heavy.3.multim50
ttgggtttggggtgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttaatcac

SEQ ID NO: 786897 - DNA, 519 bp, Homo sapiens
  misc_feature: NA.48.27.C05.4.454.heavy.3.multim50
agggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaagggacctcggtcgccgttttcctcasgcctccaccaagggccccwcg

SEQ ID NO: 786898 - DNA, 500 bp, Homo sapiens
  misc_feature: NA.48.27.C05.6.454.heavy.3.multim50
agggtttgggggtgactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgtactacacaccatcttgacgactggggatgtcttttcatttcgtggggccagggggaccgtggtcggccgtgtctacagcctccaccaacgggcccacgtcggtctttccccctggccaccct

SEQ ID NO: 786899 - DNA, 467 bp, Homo sapiens
  misc_feature: NA.48.67.G01.1.454.heavy.3.multim50
ttgggtttgggggctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggcttgtttattactgtgcgagagtgcgggtatttcacctacacragg

SEQ ID NO: 786900 - DNA, 623 bp, Homo sapiens
  misc_feature: NA.48.67.G01.3.454.heavy.3.multim50
ttgggtttggggtctgggagacgagcccagcactggaagtcgccggtgtttccattcggtgctcagcactgaacacagaggactcaccatggagtttgggctgaactgggttttcctcgttgctcttttaagagatgtccagtgtcgggtkcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccagagcacctccgagagcacagcggccctgggcygcctggtcaaggactacttcctatgtata

SEQ ID NO: 786901 - DNA, 501 bp, Homo sapiens
  misc_feature: NA.48.67.G01.5.454.heavy.3.multim50
ttgggtttgggggactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgtacacacaccatcttgacgactgggggatggcttttctatttctgggggccagggggaccgtgggtcgccgtgtctacagcctccacccgaasggscccatccggtcctttccccctcgggcsta

SEQ ID NO: 786902 - DNA, 483 bp, Homo sapiens
  misc_feature: NA.48.67.G01.6.454.heavy.3.multim50
ttgggtttggggggtctcagagaggagccttagccctggactccaaggcctttccacttggtgatcagcactgagcacagaggactcaccatggaattggggctgagctgggttttccttgttgctattttagaaggtgtccagtgtgaagtgcagctggtggagtctgggggaggcttggtccagcctggggggtccctaagactctcctgtgcagcctctggattcacctttagtacctattggatgacctggatgaacagcctgagagccgaggacgcggctgtgtattactgtgcgagagatgcgaatccctctgatagtaatggtcgttattatgatgcttttgatatgtggggccaagggacaacggtcaccgtctcttcagcctccaccaagggcccatcggtcttccccgtcggcgccctcgctccacggagcgacctccgagacggcaccagccggcccgtcgggctcggtccg

SEQ ID NO: 786903 - DNA, 442 bp, Homo sapiens
  misc_feature: NA.48.67.G01.4.454.heavy.3.multim50
ttgggtttggggatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagat

SEQ ID NO: 786904 - DNA, 605 bp, Homo sapiens
  misc_feature: NA.49.33.C11.5.454.heavy.3.multim50
ttgggtttggggagctctgagagaggagcccagccctgggattttcaggtgttttcatttggtgatcaggactgaacagagagaactcaccatggagtttgggctgagctggctttttcttgtggctactttaaaaggtgtccagtgtgacgtccaactggtggagtctgggggaggcttggtgcagcctggggggtccctgagactctcctgtgtagcctctgagttcacctttagagtctatgccatgagttgggtccgccaggctccagggaaggggctggagtgggtctcaggtatcagtggtaatgatggtaacacaaactatgcagactccgtgaagggccggttcaccatctccagagacaattccaagaatatgctatttctgcaaatgaacagcctgagaatcgaggacacggccgtatattactgtgtgaaagaagatggaccgctggacgaggacgccctacggyrggtcctactttgactactggggccggggaacccgtggtcaccgtctcctcacgcctccaccaagggcccatcggtccttcccctggcaccctcctccaagagcacctcgtgggggcacagcggccgtc

SEQ ID NO: 786905 - DNA, 484 bp, Homo sapiens
  misc_feature: NA.49.33.C11.9.454.heavy.3.multim50
ttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcagtgggatttgactacgtggggccaggggaaccccggtcaccgtctcctctcgcctcc

SEQ ID NO: 786906 - DNA, 619 bp, Homo sapiens
  misc_feature: NA.48.62.F07.1.454.heavy.3.multim50
aagggaaagggggagagaggagccttagccctggattccaaggcctatccacttggtgatcagcactgagcaccgaggattcaccatggaactggggctccgctgggttatccttgttgctattttagaaggtgtccagtgtgaggtgcagctggtggagtcagggggaggcctggtcaagcctggggggtccctgagactctcctgtgcagcctctggattcaccttcagtacctataccatgaactgggtccgccaggctcaagggaaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 786907 - DNA, 345 bp, Homo sapiens
  misc_feature: NA.13.42.D09.3.454.heavy.3.multim50
agggaaaggggctggtgtgggtctcacggattgacaatgatgggagagacacaatccacgcggattctgtgaggggccgattcaccacatcgagagacaacgccaagaacacggtatatctgcaaatgaacagtctgagaggcgaagacacggcggtttacttctgtgcaagaggtggctggtcgcatggttttgatctctggggccaggggacaatggtaaccgtctcttcagcctccaccaagggcccatcggtcttccccctggcgccctgctccaggagcacctccgagagcacagcggccctgggctgcctggtcaaggactacttcctagtacgtgacg

SEQ ID NO: 786908 - DNA, 484 bp, Homo sapiens
  misc_feature: NA.48.62.F07.3.454.heavy.3.multim50
aagggaaagggggctttctgagagtcagggatctcatgtgcaagaaaatgaagcacctgtggttcttcctcctgctggtggcggctcccagatgggtcctgtcccagctgcagctgcaggagtcgggcccaggactggtgaagcyttcggagaccctgtccctcacctgcactgtctctggtggctccatcagcagtagtagttactactggggttggatccgccagcccccagggaaggggctggagtggattgggagtatgcactatagtgggagcgacccactacaccccgtccctcaagagtcgagtcaccatatccgtagtacacgtccaagaatcagttctccctgaagctgacctctgtgaccgccgcagacacggctgtttattactgtgtgagacgggtgccccaagaaaagtgtttatcctgggccagggaaccctggtcaccgtctcctcagcctccaccaagggcccagtcc

SEQ ID NO: 786909 - DNA, 465 bp, Homo sapiens
  misc_feature: NA.48.45.E01.1.454.heavy.3.multim50
acccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagacctctggatacaccttcacgaactgtgctattcattgggtgcgacaggcccctggacaagggcttgagtggatggggtggatcaacaccaacactgggaacccaacgtatgcccagggcttcacaggacgatttgtcttctccttggacacctctgtcaatacggcacatctgcagatcaccagcctgaagactgaggacactgccgtgtattcttgtgtgagacgaagtagtagctcgccctcctttgactactggggccagggaaccctggtcaccgcctcc

SEQ ID NO: 786910 - DNA, 367 bp, Homo sapiens
  misc_feature: NA.13.42.D09.5.454.heavy.3.multim50
agggaaaggggctggagtgggtaggtttcattaggagcaattctcatgatgggacaacagaatacgccgcgtctgtaaaaggcagattcaccatctcaagagatgagtccagaagcatcgcctttctgcagatgagtagcctgaagaccgaggacacagccatctattactgtgctagagagtattgcagtcctacgacctgctatggggccttggtggccactggggccagggcaccctggtcaccgtctccgcagcctccaccaagggcccatcggtcttccccctggcaccctcctccaagagcacctctggggcacagcggccctgggctgcctggtcaaggactacttcctagtacgtgacg

SEQ ID NO: 786911 - DNA, 466 bp, Homo sapiens
  misc_feature: NA.48.45.E01.2.454.heavy.3.multim50
ctctgggagaggagccccagccctgagattcccaggtgtttccattcagtgatcagcactgaacacagaggactcaccatggagttgggactgaactggattttccttttggctattttaaaaggtgtccagtgtgaactgcaactggtggagtctgggggaggcttggtacagcctggcaggtccctgagactctcctgtgcagcctctggattcacctttggtgattatgccatgcactgggtccggcaagctccagggaagggcctggagtgggtctcaggtattagttggaatagtgatagcataggctatgcggactctgtgaagggccgattcaccatctccagagacaacgccaagaactccctgtatctgcaaatgaacagtctgagaactgaggacacggccttgtattactgtagtaaaagatatgtagtttttggggttcgggggtaggttggga

SEQ ID NO: 786912 - DNA, 462 bp, Homo sapiens
  misc_feature: NA.48.45.E01.4.454.heavy.3.multim50
tctgagagaggagccttagccctggattccaaggcctatccacttggtgatcagcactgagcaccgaggattcaccatggaactggggctccgctgggttatccttgttgctattttagaaggtgtccagtgtgaggtgcagctggtggagtcagggggaggcctggtcaagcctggggggtccctgagactctcctgtgcagcctctggattcaccttcagtacctataccatgaactgggtccgccaggctccagggaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagaggtgggacctacgtcgttcctacg

SEQ ID NO: 786913 - DNA, 457 bp, Homo sapiens
  misc_feature: NA.53.29.C07.1.454.heavy.3.multim50
agggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatgactcgtccccggactttgtac

SEQ ID NO: 786914 - DNA, 358 bp, Homo sapiens
  misc_feature: NA.53.29.C07.2.454.heavy.3.multim50
agggaaaggggctgttgtgggtctcacgtattaatggagatgggagcagcacacacaacgcggactccgtgaagggccgattcatcatctccagagacaacgtcaagaatatactatatctgcagatgaatggtctgagggccgacgactcggctgtgttctactgtgcaagaggcggcagtggctacagtgcctactactacggtctggacgtctggggccaggggaccactgtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 786915 - DNA, 476 bp, Homo sapiens
  misc_feature: NA.48.24.C02.1.454.heavy.3.multim50
tagggaaaggggtctgagagaggagcccagccctgggattctcaggtgttttcatttggtgatcaggactgaacagagagaactcaccatggagtttgggctgagcgtggctttttcttagtggctattttaaaaggtgtccagtgtgaggtgcacctgttggagtctgggggaggcttggtacagcctggggggtccctgagactctcctgtgcagcctctggattcacctttagcagctatgccatgagctgggtccgccaggctccagggacggggctggagtgggtctcagctattagtggtagtggtggtggcacatactacgcagactccgtgaagggccggttcaccatctccagagacaattccaagaacacactttatctgcgaatgaacagcctgagagccgaggacacggccgtatattactgtgcgaaagaagtcagggttactatgatatcgggaggatttcg

SEQ ID NO: 786916 - DNA, 489 bp, Homo sapiens
  misc_feature: NA.13.76.G10.1.454.heavy.3.multim50
agggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggccaagggacccggtctacccg

SEQ ID NO: 786917 - DNA, 625 bp, Homo sapiens
  misc_feature: NA.52.62.F07.1.454.heavy.3.multim50
aagggaaaggggtctgggagaggagcccagcactagaagtcggcggtgtttccattcggtgatcagcactgaacacagaggactcaccatggagtttgggctgagctgggttctcctcgttgctcttttaagaggtgtccagagtcaggtgcagctggtggagtctgggggaggcgtggtccagcctgggacgtccctgcgactctcctgttcagcctctggattcaccttctacacctttggcatgttctgggtccgccaggctccaggcaaggggctggagtgggtggcctttatatcatatgatggaactcaagaaaaatatgcagattccctgaggggccgactcaccatctccagagacaattccaagagcacactgtttctgcaaatgaacagcctgagacctgaggacacggctgtctactactgtgcgaggccgccaacaccctacggtgactacgtactactacttcgcccactggggccaggggagtctggtcaccgtctcttcagcctccaccaagggcccatcggtcttccccctggcaccctcctccaagagcacctctgggggcacagcggccctgggctgcctggtcaaggactacttcctatacgatcg

SEQ ID NO: 786918 - DNA, 426 bp, Homo sapiens
  misc_feature: NA.48.45.E01.5.454.heavy.3.multim50
catcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtatagcaaactacgcacagaagttccagggcagagtcacgattaccgcggacaaatccacgagcacagcctacatggagctgagcagcctgagatctgaggacacggccgtgtattactgtgcgagagatcagagtggttatt

SEQ ID NO: 786919 - DNA, 331 bp, Homo sapiens
  misc_feature: NA.13.42.D09.4.454.heavy.3.multim50
agggaaagggactggagtggattgcatacatgagtggaggtggagccaccagatactacgcagagtctgtgaaggaccgtttcatcatttccagagacaacgccaagaactctctgttcctacaaatgaatcgcctgagccccgaggacacggctgtctactactgcgggagacgaggctttgactactggggccagggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 786920 - DNA, 460 bp, Homo sapiens
  misc_feature: NA.49.33.C11.6.454.heavy.3.multim50
ttgggtttggggatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgaacacagcctacatggaactgcgcagcctaggatctgycsgacaccgggccgtatwwttctgtgcgagagagatgttctttctatgatagtactagtcattatgt

SEQ ID NO: 786921 - DNA, 458 bp, Homo sapiens
  misc_feature: NA.48.45.E01.7.454.heavy.3.multim50
atgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccgaagggacaagtggtctaccgtctc

SEQ ID NO: 786922 - DNA, 614 bp, Homo sapiens
  misc_feature: NA.48.45.E01.10.454.heavy.3.multim50
ctctgggagaggagccccagccctgagaatcccaggtgtttccattcagtgatcagcactgaacacagaggactcaccatggagttgggactgagctggattttccttttgactattttaaaaggtggtcactgtgaacggctactggtggagtctgggggaggcttggtacagcctggcaggtccctgaaactctcctgtgtagcctctggattcaggttgggcgattatgccatgcaatgggtccggcaaggtccagggaagggcctggagtgggtctcaggcatcgattggaaaagtcgagaagattgactatgcggagtctgtgaaggggcgattcgatcatctccagagacaacggccaagaactccctgtatttgcagatgaacaatctgagacctgacgacacggccttgtattattgttgcaaaagttgtggagtcacagtctctggactacggtatggacgtctggggccaagggaccacggtcacagtctcctcagcctccaccaagggcccatcggtcttcccctggcaccctcctccaagagcacctctgggggcacagcggccctgggctgcctggtcaaggactacttcctatgtatact

SEQ ID NO: 786923 - DNA, 464 bp, Homo sapiens
  misc_feature: NA.48.70.G04.3.454.heavy.3.multim50
acccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagacctctggatacaccttcacgaactgtgctattcattgggtgcgacaggcccctggacaagggcttgagtggatggggtggatcaacaccaacactgggaacccaacgtatgcccagggcttcacaggacgatttgtcttctccttggacacctctgtcaatacggcacatctgcagatcaccagcctgaagactgaggacactgccgtgtattcttgtgtgagacgtaagtagtagctcgccctcctttgactactggggccagggaaccctggtcaccgcct

SEQ ID NO: 786924 - DNA, 464 bp, Homo sapiens
  misc_feature: NA.48.70.G04.4.454.heavy.3.multim50
agcatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaagcctggggcctcagtgaagatttcctgcaaggcatctggatacatcttcaccacctacaatatacactgggtgcgacaggcccctcgacaagggcctgagtggatggggatgatcaaccctaggtatggcagcacaagccacgcagagaagttccagggcagagttatcatgaccagcgacacgtccacgagcacagtctacatgagtctgagcagcctgrgatctgtagaacgacggaccggtccgtctacgttaacttcgttgtcggacggagggggggtacggggggttcccrrgtacsgaaccg

SEQ ID NO: 786925 - DNA, 449 bp, Homo sapiens
  misc_feature: NA.40.85.H08.1.454.heavy.3.multim50
tcgcggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccagggaaccctggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 786926 - DNA, 471 bp, Homo sapiens
  misc_feature: NA.40.85.H08.2.454.heavy.3.multim50
tcgcggggggtctcagagaggagccttagccctggactccaaggcctttccacttggtgatcagcactgagcacagaggactcaccatggaattggggctgagctgggttttccttgtagctattttagaaggtgtccagtgtgaggtgcagctggtggagtctgggggaggtttggtccagcctggggggtccctaagactctcctgtgcagcctctggattcacctttagtaccttttggatgacctgggtccgccaatctccagggagggggctggagtgggtggccaacataaagggagatggaagtcggacacactatgtggactctgtgaagggccggttcaccatctccagagacaacgccaacgagtcactgtatctgcagatgaacagcctgagacccgaggacgcggctgtgtattactgtgcgagagatgcgaatccgtctgacagcagtggtcgttacg

SEQ ID NO: 786927 - DNA, 465 bp, Homo sapiens
  misc_feature: NA.48.20.B09.3.454.heavy.3.multim50
agggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 786928 - DNA, 484 bp, Homo sapiens
  misc_feature: NA.49.86.H09.4.454.heavy.3.multim50
ttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactacgtggggccaggggaaccccggtcaccgtctcctctgcctcccg

SEQ ID NO: 786929 - DNA, 470 bp, Homo sapiens
  misc_feature: NA.51.30.C08.2.454.heavy.3.multim50
aagggaaaggggctgggagacgagcccagcactcgaagtcgccggtgtttccattcggtgatcatcactgaacacagaggactcaccatggagtttgggctgagctgggttttcctcgttgctcttttaagaggtgtccagtgtcaggtgcggctggtggagtctgggggaggcgtggtccagcctggggattccctgagaatctcctgtgcagcctctggattcaacttcaatagacatcctatgcactgggtccgccaggctccaggcaaggggctggaatgggtggcagttatttcgtccactggaaacagtaaacattatggacgctccgtgaagggcccattcgccatctccagagacaattccaaaaataccctctatctgcgaatgaacagcctgcgacctgaagacacggctatatatttctgtgcgagaggggagtcttattgtaatgatggttcctgctt

SEQ ID NO: 786930 - DNA, 470 bp, Homo sapiens
  misc_feature: NA.51.30.C08.3.454.heavy.3.multim50
aagggaaaggggaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactactggggccagggaaccctggtcaccgtctcctcagcctccaccaagggcccatcggtcttcccctggcgccctgctccaggagcacctccgagagcacagcggcccgtgggcg

SEQ ID NO: 786931 - DNA, 653 bp, Homo sapiens
  misc_feature: NA.51.30.C08.5.454.heavy.3.multim50
aagggaaaggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtacagccagggcggtccctgagactctcctgtacagcctctggattcacctttggtgattatgctatgagctgggtccgccaggctcaagggaaaggggctggagtgggtaggtttctttagaggcaaagcttatggtgggacaacagaatacgccgcgtctgtgataggccgattcaccatctcaagagatgattccaaaagcatcgcctatctgcacatgagcagcctgaaaaccgaggacacagccgtgtatttctgtactagagtcttcttatattactatgatactagtggttattcaggagtggggcacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 786932 - DNA, 464 bp, Homo sapiens
  misc_feature: NA.52.53.E09.4.454.heavy.3.multim50
ttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctggtcaaggactacttcctatacgatcg

SEQ ID NO: 786933 - DNA, 500 bp, Homo sapiens
  misc_feature: NA.52.29.C07.2.454.heavy.3.multim50
agggaaaggggcctctactgatgaaaaccagcccagccctgassswrmrgskctgggagacgagcccagcactggaaggcgccggtgtttccattcggtgatcagcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagcaactatgcaatgcactgggtccgcctggctcccggcaagggtctggactgggtggcaggtatatcagatgatgggaccaaaaatactacgcaaactccgtgaagggccgattcaccgtatctagagacagttccgatgacacaatctatctgcaaatgaacagcctgaaagttgacgacacgggtyytttttactgtgcgcctgggagcgagtggctggccacatg

SEQ ID NO: 786934 - DNA, 497 bp, Homo sapiens
  misc_feature: NA.48.78.H01.2.454.heavy.3.multim50
acccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaaagggttttactagtgggttcggggagtcgtccgacccagcaacgtgggtttccgaccccgtggggccgagggaacccgtggtcaccgtt

SEQ ID NO: 786935 - DNA, 464 bp, Homo sapiens
  misc_feature: NA.48.82.H05.3.454.heavy.3.multim50
cacgaccggtgctcgatttagacgcgatcgaagggtttgggggctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtggaggggccgattcgccttctccagagacaattccaagagcacggttcatctgcaaatgagcgccctgacgacctgacgacacggctggtctatttacg

SEQ ID NO: 786936 - DNA, 455 bp, Homo sapiens
  misc_feature: NA.40.34.D01.2.454.heavy.3.multim50
ttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccgggaatcctggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 786937 - DNA, 334 bp, Homo sapiens
  misc_feature: NA.49.79.H02.2.454.heavy.3.multim50
agggaaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgagagcacagcggccctgggctgcctggtcaaggactacttcctctctcgact

SEQ ID NO: 786938 - DNA, 617 bp, Homo sapiens
  misc_feature: NA.48.78.H01.4.454.heavy.3.multim50
tctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggaktyrgrkgkmkgtgttggkyywgcskgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggcgccctgctccaggagcacctccgagagcacagcggccctgggctgcctggtcaaggactacttcctatgtatactc

SEQ ID NO: 786939 - DNA, 608 bp, Homo sapiens
  misc_feature: NA.48.78.H01.5.454.heavy.3.multim50
agctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcggatttcacctacacagggctsgttcgacccctggggccagggaaccctagtcaccgtctcctcagcctccaccaagggcccatcggtcttcccctggcaccctcctccaagagcacctctgggggcacagcggccctgggctgcctggtcaaggactacttcctatgtatact

SEQ ID NO: 786940 - DNA, 539 bp, Homo sapiens
  misc_feature: NA.49.86.H09.1.454.heavy.3.multim50
ttgggtttgggggagtctccttcaccacccagctgggatctcagggcttccttttctgtcctcctccaggatggggtcaaccgccatcctcgccctcctcctggctgttctccaaggggtctgtgccgaggtgcaactggtgcagtccggagcagaagtgaaaaagcccggggagtctctgaggatctcctgtaagatttctggagacaccttaaccacctattggatcagctgggtgcgccagatgcccggtaaaggcctggaatggatggggatgattgatcccagtgactcttttaccacgtacggcccgtccttccaatggcacgtcaccatctcagctgacaagtcccaaaggagtgcctccctggagtggaccagcctgagggcctcggacaccgccatgtattactgtgcaatgggggtcgggggagcagtgtctggcaattattactactactctgtggacgtcgtggggccgaggggacctcggtccgccsgtctccctcgacgccyyccacccgaacgggcccagttcc

SEQ ID NO: 786941 - DNA, 614 bp, Homo sapiens
  misc_feature: NA.49.86.H09.3.454.heavy.3.multim50
ttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttgacctactgcggccmgggaaccctagtcaccgtctcctcagcctccaccaagggcccatcggtcttccccctggcaccctcctccaagagcacctctgggggcacagcggccctgggctgcctggtcaaggactacttcctctctcgact

SEQ ID NO: 786942 - DNA, 487 bp, Homo sapiens
  misc_feature: NA.49.86.H09.6.454.heavy.3.multim50
ttgggtttgggggatttgggggcaatttatgaacccgaaaggacatggccatggggtgggtagggacagtagggacagatgtcagcctgaggtgaagcctcaggacacaggtgggcatggacagtgtccacctaagcgagggacagacccgagtgtccctgcagtagacctgagagcgctgggcccacagcctcccctcggggccctgctgcctcctcaggtcagccctggacatcccggctttccccaggcctggcggtaggtttgaagtgaggtctgtgtcactgtggtcttactatgatagtagtggttatattagcagccactcaagcacattcggctactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 786943 - DNA, 477 bp, Homo sapiens
  misc_feature: NA.49.86.H09.9.454.heavy.3.multim50
ttgggtttggggacccaacaaccacatccctcctcagaagcccccagagcacaacgcctcaccatggactggacctggaggatcctctttttggtggcagcagccacaggtgcccactcccaggtccaacttgtgcagtctggggctgagttgaagaagcctggggcctcagtgaaggtttcctgcacggtttctggataccccctcagcagtcatgctatgcattgggtgcgccaggcccccggacaaaggtttgagtggatgggatggatcaccgctggcaatggtgacacaaaatattcacaaaagttccagggcagagtcaccatttacagggtacacatctgcgagttcaggctacatggaactgagcgggcctggagagtactgaggacgacggctatttattactgttgcgagagggaawkgggatattgtgtcagctccaggtgcccagcccggccccctactttgwac

SEQ ID NO: 786944 - DNA, 452 bp, Homo sapiens
  misc_feature: NA.49.86.H09.10.454.heavy.3.multim50
ttgggtttggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctggggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatagtagactccgtggaagggccgattcatcatctccagagacaactccgagaacacgctgtatctgacaaatgaacaggctagagagctgaagacgacggctagtatattactgtgcgtaacttamg

SEQ ID NO: 786945 - DNA, 477 bp, Homo sapiens
  misc_feature: NA.48.78.H01.7.454.heavy.3.multim50
atgcttttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagttatttaccacagtgggagcacctactacaacccgtccctcaaaagtcgaggcaccatatccgtagacacgtccaagaaccaattctccctgaagctgagctctgtgaccgccgcagacacggctgtctattactgtcgcgaggccccgagccgcacgtggtctttttgtatgkcctttgattakkgtksggkrccgaaggggacgaagtacggtckacccgttctt

SEQ ID NO: 786946 - DNA, 482 bp, Homo sapiens
  misc_feature: NA.49.86.H09.7.454.heavy.3.multim50
ttgggtttgggtytgggagaggagcccagcactgggattccgaggtgtttccattcagtgatctgcactgaacacagaggactcgccatggagtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagagtcccccgggtatacgcagtgtctggtacatattactsgggccac

SEQ ID NO: 786947 - DNA, 483 bp, Homo sapiens
  misc_feature: NA.51.30.C08.6.454.heavy.3.multim50
aagggaaagggggggagaggagcccagcactagaagtcggcggtgtttccattcggtgatcagcactgaacacagacgactcaccatggactttgggctgagctgggttttcctcgttgctcttttaagaggtgtccactgtcaggtgcagttggtggagtctgggggaggcgcggtccagyctgggaggtccctgaggctctcctgcgcgtcctctggactccccttcagcacttatgacatgcactgggtccgccaggctccaggcaaggggctggagtgggtggcagtcatatcatatgatggaaaggataagtactatgcagactccatggaagggccgatccaccactctccagggacaattccaagaacacactgtatctgacaaataaacaacctagagagttgcggacacggctgtctattactgtgcggyacgtgggggtacgtacggtgacgaacgtcactacctaccyaccg

SEQ ID NO: 786948 - DNA, 452 bp, Homo sapiens
  misc_feature: NA.48.78.H01.8.454.heavy.3.multim50
ctctgggagaggagccccagccctgagattcccaggtgtttccattcagtgatcagcactgaacacagaggactcaccatggagttgggactgagctggattttccttttggctattttaaaagctgtccagtgtgaagtgcacctggtggagtctggggggaggcttggtacagcctggcaggtccctgagactctcctgtgcagcctctggattcacctttgatgattatgccatgcactgggtccggcaagttccagggaagggcctggagtgggtctcaggcattagtagaattaggggtagcatagcctatgcggattctgtgaagggccgattcaccatctccagagacaacgccaagaactccctgtatctgcaaatgaacagtctgagacctgaggacacggccttctattactgtgacaaaagatacaggcattagactaacg

SEQ ID NO: 786949 - DNA, 444 bp, Homo sapiens
  misc_feature: NA.48.78.H01.9.454.heavy.3.multim50
catcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagatawggacaactttc

SEQ ID NO: 786950 - DNA, 533 bp, Homo sapiens
  misc_feature: NA.49.12.B01.1.454.heavy.3.multim50
tccgcgggcacgaccggtgctcgatttagtagtgtagattccgcggggagctctgagagaggagcccagccctgggattttcaggtgttttcatgtggtgatcaggactgaacagagagaactcaccatggagtctgggctgacgtggctttttcttgtggctattttaaaaggtgtccagtgtgacgtgcaactggtggagtctgggggaggcttggtacagccgggggggtccctgagactctcctgtacagcctctggcttcacctttagagtctatgacatgagttgggtccgccaggctccggggaaggggctggagtgggtctcaacgatcagtgaaagtggaagtaccacaaagtacgccgactccgtgaagggccggtgcaccatctccagagacaattcgaaggacactttatatctgcaactcaacagactgacaaccgcggacacggccgtctattactgtgtgaaagaagacggaccgctggacgaggagccagaggagaatcactactttgaaccacgtc

SEQ ID NO: 786951 - DNA, 688 bp, Homo sapiens
  misc_feature: NA.49.12.B01.4.454.heavy.3.multim50
tccgcgggcacgaccggtgctcgatttagtagtgtagattccgcgggcacgaccggtgctcgatttagtastrkmgactttgggtttggggtctgagagaggagcccagccctgggattttcaggtgttttcatttggtgatcaggactgaacagagagaactcaccatggagtttgggctgagctggctttttcttgtggctactttaaaaggtgtccagtgtgacgtccaactggtggagtctgggggaggcttggtgcagcctggggggtccctgagactctcctgtgtagcctctgagttcacctttagagtctatgccatgagttgggtccgccaggctccagggaaggggctggagtgggtctcaggtatcagtggtaatgatggtaacacaaactatgcagactccgtgaagggccggttcaccatctccagagacaattccaagaatatgctatttctgcaaatgaacagcctgaagaatcgaggacacggccgtatattactgtgtgaaagaagatggaccgctggacgaggagccctacggccgggtcctactttgactactggggccggggaaccctggtcaccgtctcctcagcctccaccagggacccactcggtccttccccctcggccaccctccctccaacgagcacctctgggggcacagcggccctgggc

SEQ ID NO: 786952 - DNA, 479 bp, Homo sapiens
  misc_feature: NA.48.37.D04.1.454.heavy.3.multim50
ttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagaggaaaggggttttactagttgggttcgggggaggtcstccgacccagccaactgggtttccg

SEQ ID NO: 786953 - DNA, 412 bp, Homo sapiens
  misc_feature: NA.48.78.H01.6.454.heavy.3.multim50
agctctgagagaggagccttaggcctcgattccaaggcctatccacttggtgatcagcactgagcaccgaggattcaccttggaactggggctccgctgggttttccttgttaatgttttagaaggtgtccagtgtgaggtgcagttggtggagtctgggggaggcctggtcaagtcgggggggtccctgagagtctcttgtgcagcctctagactcagtttcaatcaatgagacttggatttcctagtgtcactgcaatatggacgtctggggccaagggaccacggtcaccgtctcgtcagcttccaccaagggcccatcggtcttccccctggcgccctgctccaggagcacctctgggggcacagcggccctgggctgcctggtcaaggactacttcctatgtatact

SEQ ID NO: 786954 - DNA, 470 bp, Homo sapiens
  misc_feature: NA.53.76.G10.2.454.heavy.3.multim50
agggggagtctccctcactgcccagctgggatctcagggcttcattttctgtcctccaccatcatggggtcaaccgccatcctcgccctcctcctggctgttctccaaggagtctgtgccgaggtgcagctggtgcagtctggaacagaggtgaaaagccgggggagtctctgaagatctcctgtaagggttctggatacaactttaccacctactggatcgcctgggtgcgccagatgcccggaaaaggcctggagtggatgggcatcgtcaatcctagtgactctgaagccacatacagcccgtccttccaaggccaggtcaccctctcagccgacaagtccatcagcgccgccttcctgcagtggcgcggcctggaggcctcggacaccgccacatattactgtgcgagacttacatttggggggagttagtcgttgttcctccactgggtgtcttttgattgtctc

SEQ ID NO: 786955 - DNA, 332 bp, Homo sapiens
  misc_feature: NA.49.24.C02.1.454.heavy.3.multim50
tagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 786956 - DNA, 474 bp, Homo sapiens
  misc_feature: NA.40.12.B01.2.454.heavy.3.multim50
tccgcggggagctctgggagaggagccccagccctgagattcccaggtgtttccattcagtgatcagcactgaacacagaggactcaccatggagttgggactgagctggattttccttttggctattttaaaaggtgtccagtgtgaagtgcaactggtggagtctgggggagacttggtacagcctggcaggtccctgagactctcctgtacagcctctggattcacctttggtgattatgccatgcactgggtccggcaagctccagggaagggcctggagtgggtctcaggtatgaattggaacagtgctagtatcggctatgcggactctgtgaggggccggttcaccatctccagagacagcgccaagagttccctgtacctgcaaatgaacagtctgagaattgaggacacggccttgtattattgtgcgaaggggactagtggttcggggagggccttccactatg

SEQ ID NO: 786957 - DNA, 460 bp, Homo sapiens
  misc_feature: NA.11.57.F02.1.454.heavy.3.multim50
ttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatctccagagacaatggcaacaactcactgtatctggaaatcaacagcctgagagtcgaggacacggctgtatattattgtgcgagacgccccctacggtcgtacg

SEQ ID NO: 786958 - DNA, 469 bp, Homo sapiens
  misc_feature: NA.48.37.D04.4.454.heavy.3.multim50
ttgggtttggggggtctcagagaggagccttagccctggactccaaggcctttccacttggtgatcagcactgagcacagaggactcaccatggaattggggctgagctgggttttccttgttgctattttagaaggtgtccagtgtgaagtgcagctggtggagtctgggggaggcttggtccagcctggggggtccctaagactctcctgtgcagcctctggattcacctttagtacctattggatgacctggatgaacagcctgagagccgaggacgcggctgtgtattactgtgcgagagatgcgaatccctctgatagtaatggtcgttattatgatgcttttgatatgtggggccaagggacaacggtcaccgtctcttcagcctccaccaaggcccatcggtcttcccctggcgccctgctccaggagcacctccgagagcacagcggccctgggctgtccg

SEQ ID NO: 786959 - DNA, 455 bp, Homo sapiens
  misc_feature: NA.48.82.H05.4.454.heavy.3.multim50
cacgaccggtgctcgatttagtacacgtgattagggattggggacccaacaaccacatccctcctcagaagcccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaaagacracggcagtatattactgtgcgagaggcggatt

SEQ ID NO: 786960 - DNA, 492 bp, Homo sapiens
  misc_feature: NA.13.10.A10.3.454.heavy.3.multim50
agggtcttcgtggctcacgtccaccaccacgcatgtgacctcaggggtccgggagatcatgagggtgtccttgggttttggggggaagaggaagactgacggtccccccaggagttcaggtactgggcacagaggactcaccatggagtttgggctgaggtggtttttccttggtgctattttaaaaggtgtccattgtgaagtgcccctggtacaatctgggggaggcttggtcaagccgggggagtccctgagactctcctgtgaagcctcaacattcacttttgctcgtgcctgggtgacctgggtccgccaggctccagggaaggggctggagtggattggccatattaaggacagacctaatggcgcgacagcacactaccttgaatccgtcaaagacagattcatcatctcgagaggtgattccgacaacacggtgtctctccatatgagcagcctagaaaatcgaggacacaggcctatattacg

SEQ ID NO: 786961 - DNA, 631 bp, Homo sapiens
  misc_feature: NA.48.37.D04.5.454.heavy.3.multim50
ttgggtttgggggggagaggagctccagccttgggactcccagctgtctccactcggtgatcggcactgaatacaggagactcaccatggagtttgggctgagcgtgggttttccttgttgctattttaaaaggtgtccagtgtkrggtttgggtgbbgvagtygctggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctcgggctgcctggtcaaggactacttcctatgtatact

SEQ ID NO: 786962 - DNA, 296 bp, Homo sapiens
  misc_feature: NA.52.58.F03.4.454.heavy.3.multim50
aagggccggtgcaccatctccagagacaattcgaaggacactctatacctgcaactcaacagactgacacccgcggacacggccgtctattactgtgtaaaagaagacggaccgctggacgaggagccagaggagaatcactactttgactactggggccagggaagactggtcaccgtctcctccgcctccaccaagggcccatcggtcttccccctggcaccctcctccaagagcacctctgggggcacagcggccctgggctgcctggtcaaggactacttcctatacgatcg

SEQ ID NO: 786963 - DNA, 498 bp, Homo sapiens
  misc_feature: NA.48.37.D04.7.454.heavy.3.multim50
ttgggtttgggggctttytgrgwktsrkggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattggggagtatttaccacaggtgggagcacctactacaacccgtccctcaaaagtcgaggcaccatatccgtagacacgtccaagaaccaattctccctgaagctgagctctgtgaccgccgcagacacggctgtctattactgtgcgacggccccgagcgcagtggtcttttgtatgtcctttgattatggtggggccgaaggggaacaagtggtccgaccgtctcttcagcctccaccaggccc

SEQ ID NO: 786964 - DNA, 334 bp, Homo sapiens
  misc_feature: NA.49.37.D04.7.454.heavy.3.multim50
ttgggtttgggggggagaggagcccagcactgggattccgaggtgtttccattcagtgatctgcactgaacacagaggactcgccatggagtttgggctgagctgggttttccttgttgctattttaaaaggtgtccagtgtgatgtgcaggtggtggagcccgggtatagcagtgtctggtacatattactggggccagggaaccctggtcaccgtctcctcagcctccaccaagggcccatcggtcttccccctggcgccctgctccaggagcacctccgagagcacagcggccctgggctgcctggtcaaggactacttcctctctcgact

SEQ ID NO: 786965 - DNA, 543 bp, Homo sapiens
  misc_feature: NA.48.33.C11.3.454.heavy.3.multim50
ttgggtttggggggattcccaggtgtttccattcagtgatcagcactgaacacagaggactcaccatggagttgggactgagctggattttccttttggctattttaaaagctgtccagtgtgaagtgcacctggtggagtctgggggaggcttggtacagcctggcaggtccctgagactctcctgtgcagcctctggattcacctttgatgattatgccatgcactgggtccggcaagttccagggaagggcctggagtgggtctcaggcattagtagaattaggggtagcatagcctatgcggattctgtgaagggccgattcaccatctccagagacaacgccaagaactccctgtatctgcaaatgaacagtctgagacctgaggacacggccttctattactgtgcaaaagatcaggcattagactacaacggtatggacgtctggggccaagggatcacggtcaccgtctcctcagcctccaccaacgggcccatcggtcttccccctggccaccctcctccaagagcacctcgtc

SEQ ID NO: 786966 - DNA, 471 bp, Homo sapiens
  misc_feature: NA.48.33.C11.6.454.heavy.3.multim50
ttgggtttggggagctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctggagagacgaggacacgggtctggttttattactgtgcgagagtggcgggtatttcaacctwcacg

SEQ ID NO: 786967 - DNA, 491 bp, Homo sapiens
  misc_feature: NA.48.33.C11.8.454.heavy.3.multim50
ttgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaagggacctcggtcgtcccg

SEQ ID NO: 786968 - DNA, 496 bp, Homo sapiens
  misc_feature: NA.48.33.C11.9.454.heavy.3.multim50
ttgggtttgggggctttytgrgwktgsrkggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttcgacccctggggccagggatacctggtctaccgtctcctcagcttccaccaac

SEQ ID NO: 786969 - DNA, 470 bp, Homo sapiens
  misc_feature: NA.52.87.H10.1.454.heavy.3.multim50
ttgggtttggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaaggtttgagtggatgggatggatcaccgctggcaatggtgacacaaaatattcacagaagttccagggcagagtcaccattaacagggacacatctgcgagtacaggctacatggaactgagcggcctgagatctgaggacacggctatttattactgtgcgaggagggaagtggggataattggtggcaggctccaggtgcccagcccggaccccttacg

SEQ ID NO: 786970 - DNA, 389 bp, Homo sapiens
  misc_feature: NA.52.87.H10.2.454.heavy.3.multim50
ttgggttgggtccggcagccccccgggaagggcctggagtggattggagatatctactacagcgggggcaccagctacagtccctccctcaagagtcgagttggcatatcaatagacacgtccaagaatcagttctccctgaagctgaaatctatcattgttgcggacacggccgtctattattgtgcgagacatggcagcccatatagtcgctggttcgacccctggggcccgggaatcccggtcaccgtctccccaggtgagtcatcaccacccccagcttccaccaagggcccatcggtcttccccctggcgccctgctccaggagcacctctgggggcacagcggccctgggctgcctggtcaaggactacttcctatacgatcg

SEQ ID NO: 786971 - DNA, 369 bp, Homo sapiens
  misc_feature: NA.52.87.H10.3.454.heavy.3.multim50
ttgggtttgggtccggcagccccccgggaagggcctggagtggattggagatatctactacagcgggggcaccagctacagtccctccctcaagagtcgagttggcatatcaatagacacgtccaagaatcagttctccctgaagctgaaatctatcattgttgcggacacggccgtctattattgtgcgagacatggcagcccatatagtcgctggttcgacccctggggcccgggaatcccggtcaccgtctccccagcttccaccaagggcccatcggtcttccccctggcgccctgctccaggagcacctctgggggcacagcggccctgggctgcctggtcaaggactacttcctatacgatcg

SEQ ID NO: 786972 - DNA, 518 bp, Homo sapiens
  misc_feature: NA.48.82.H05.5.454.heavy.3.multim50
  modified_base (494)..(494): a, c, t, g, unknown or other
ccacgaccggtgctcgatttagtgtcgtcgcaagagagaggggggcatcacataacaaccacgayysstsctctrawkwagtccstsgkmgcacagctmkwsassrkggactggacctggaggttcctctttgtggtggcagcagcaacakgtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcacctttatggcggacgaatcctcgagcacagtctatatggatctggccaggcctgaagtctgaagacacgggcatatatttctgtgcgacagatggtcgtggattctgtctgcttatggagggggaanacgtggttcgactcctggggccac

SEQ ID NO: 786973 - DNA, 483 bp, Homo sapiens
  misc_feature: NA.52.87.H10.6.454.heavy.3.multim50
ttgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtggatggggtggaacaatcccaacagtggaggcaccggtcgcacagaatatgcgcggaagtttcarggcagggtcaccatgaccagcgacaggtccactaacacagcctacatggagctaagtagactgacatctgacgacaccgggccgtctagttattgtgtgagagagggacccgaagtgacctcggaacactggacgtcgtggggrcccg

SEQ ID NO: 786974 - DNA, 490 bp, Homo sapiens
  misc_feature: NA.52.87.H10.5.454.heavy.3.multim50
ttgggtttggggagctctgagagaggaggccagccctgggattttcaggtgttttcatttggtgatcaggactgaacagagagaactcaccatggagtttgggctgagctggctctttcttgtggctattttaaaaggtgtccagtgtgacgtacagctggtggagtcggggggagccttccaacacccgggggggtccctgagactcacctgtgaagcctctggatttagatttagcagccatgccatgacctgggtcccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgacgaaagatcgaggtcgcatgactaggtttttggaggtggaccgaaagaacc

SEQ ID NO: 786975 - DNA, 470 bp, Homo sapiens
  misc_feature: NA.49.30.C08.4.454.heavy.3.multim50
aagggaaaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcttctggtggactctgggggaggcgtggtccggcctgggaggtccctgagactctcctgtgcagcctctcagttcaccttcagtgtctatactatgcactgggtccgccaggcctccaggcaaggggctggagtgggtggcacttatatacaaatgatggaagaattcaacactacgcaggctccgtgaacgggccgattcaccatctccagagacaattccaagaacacactgtctctgmmaatgaatagcctgagagttgaggacacggctgtctattactgtgcgagagcgtaagggacttactcatagatttgta

SEQ ID NO: 786976 - DNA, 458 bp, Homo sapiens
  misc_feature: NA.49.30.C08.2.454.heavy.3.multim50
aagggaaaggggacccaacaaccacatccctcctcagaagcccccagagcacaacgcctcaccatggactggacctggaggatcctctttttggtggcagcagccacaggtgcccactcccaggtccagcttgtgcagtctggggctgaggcgaagaagcctggggcctcagtgaaggtttcctgccaggcttctggatacaccctcagtacccatgctatccattgggtgcgccaggcccccggacaaagacttgagtggatgggatggatcagcgctggcaatggtgacagacactattcacagaagttccagggcagagtcaccatcaccagggacacatccgcgagcacagcctacatggaactgagcagcctgagatctgaagacacgggtgtatattactgtgcgagaggggaagtgggatattgtagatgcgccarggtcgcccgggcccc

SEQ ID NO: 786977 - DNA, 485 bp, Homo sapiens
  misc_feature: NA.53.35.D02.3.454.heavy.3.multim50
  modified_base (482)..(482): a, c, t, g, unknown or other
ttgggtttggggctgggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccgggggggaagracacactgtttcttcaaatggacttcctgagaactgaggacgacggccgtgtattactgcgcgagagtgcagtgatagttcggtttccagtgatgtcttttkaknttc

SEQ ID NO: 786978 - DNA, 409 bp, Homo sapiens
  misc_feature: NA.53.35.D02.4.454.heavy.3.multim50
ttgggtttgggctcggggctgccctttggctttggagatggttttctcgatgggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 786979 - DNA, 504 bp, Homo sapiens
  misc_feature: NA.48.53.E09.3.454.heavy.3.multim50
ttgggtttgggggctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttccgaccccgtgggggcccaggggactaccgtggtcctacccgkctcctcagcttccaccaac

SEQ ID NO: 786980 - DNA, 459 bp, Homo sapiens
  misc_feature: NA.49.41.D08.8.454.heavy.3.multim50
ctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagccctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgwwtacagcagccywcgaaacg

SEQ ID NO: 786981 - DNA, 424 bp, Homo sapiens
  misc_feature: NA.48.53.E09.5.454.heavy.3.multim50
ttgggtttggggagctctgagagaggagccttaggcctcgattccaaggcctatccacttggtgatcagcactgagcaccgaggattcaccttggaactggggctccgctgggttttccttgttaatgttttagaaggtgtccagtgtgaggtgcagttggtggagtctgggggaggcctggtcaagtcgggggggtccctgagagtctcttgtgcagcctctagactcagtttcaatcaatgagacttggatttcctagtgtcactgcaatatggacgtctggggccaagggaccacggtcaccgtctcgtcagcttccaccaagggcccatcggtcttccccctggcgccctgctccaggagcacctctgggggcacagcggccctgggctgcctggtcaaggactacttcctatgtatact

SEQ ID NO: 786982 - DNA, 611 bp, Homo sapiens
  misc_feature: NA.48.53.E09.6.454.heavy.3.multim50
gttgggtttggggggattttcaggtgttttcatttggtgatcaggactgaacagagagaactcaccatggagtttgggctgagctggctttttctagtgactatttttaaaggtgtccagtgtgaggtgcaactattggagtctgggggtggcctkgtgswkysggggggtccctgagactctcttgtgcagcctctggattcagctttagtaattatgccatgagctgggtccgccaggctccagggaaggggctggagtggatttcatctattagtggtagtggtgttaccacatactacgcagactccgtgaagggccgattcatcatctccagagacagttccaggaacacaactggatttgcaaatgaacagcctgagagccggaggacacggccctatatttactgtgcgaaatcccatgatagtagttggttttttctttttcgtttcttttgaccactggggccagggatccctgcctcaccgtctcctcagcctccaccaagggcccatcggtccttccccctggcgccctgctccaggagcacctccgagagcacagcggccctgggctgcctggtcaaggacttacttcctatgtatact

SEQ ID NO: 786983 - DNA, 501 bp, Homo sapiens
  misc_feature: NA.48.53.E09.8.454.heavy.3.multim50
ttgggtttggggacttttccaatttttttgggggccagcgctgggtctcttgccaagagaaccccggagtagttgggggggctcaggaacctgccctaagacaacagcgtccacacagacgaggggctacgggtcctcacagacgaagggcacggggtccagatgatccctcctcctggccccgccacctcgtctctttctgcggccaggcgcactctgggcctctggggtcaagtggccggcaacccccgggccctccccggcctctgtctcagagagtcccagggacgtggcggggcgccggttcttccctggggtcctggcgttgttgtcaccttgtgtcacctgtttcgacccctgggcccagggagccctggtcaccgtctccttagcctccaccaagggcccatcggtcttccccctggcgccctgctccaggagcacctccgagagcacagcggccctgggctgcctggtcaaggactacttcctatgtatact

SEQ ID NO: 786984 - DNA, 455 bp, Homo sapiens
  misc_feature: NA.49.41.D08.2.454.heavy.3.multim50
ctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgaacaggctgagagctrgaagacacggctttatattactgtgcgtaacttaatcacggaggacamcggtaccg

SEQ ID NO: 786985 - DNA, 459 bp, Homo sapiens
  misc_feature: NA.48.82.H05.6.454.heavy.3.multim50
cacgaccggtgctcgatttagyactctgmwmgttgggtttggggatgctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccacgccccccgggaagggactggaatggattgggagtatctattatacagggagcacctactaccaacccgtccctcaagagtcgagtcaccatctccgcagacacgtccaagaaccagttcctccctgaggctgagctctgtgaccgccgcagacacggctgtctattactgtgcgagaagtgggtcgtggcagtggcgt

SEQ ID NO: 786986 - DNA, 627 bp, Homo sapiens
  misc_feature: NA.49.41.D08.4.454.heavy.3.multim50
agctctgggagaagagccccagccccagaaytccmaggcmktttccaytyggtgatcagcrctgarcacagaggactcaccatggagttkgggctgagcgtgggttttccttgttgctattataaaaggtgtcccgtgtcaggtgcagctggtggagtctgggggaggcctggtcaagcctggagggtccctgaagctctcctgtgcagcctctggattcactttcagtgactactacatgaactgggtccgccaggttccagggaaggggctggagtggctttcatatatcagcagtagtggtagcaccatcttctacgcagactctgtgaagggccgattcaccatttcccgggacaacgccaagaagtcactatctctgcacatgatcagcctgagagccgaggacacggccatgtatttctgtgcgagagcccctcacggtggtgggactgtaccttattacttctacgctatggacgtctggggccaagggaccacggtcaccgtctcctcaccctccaccaagggcccatcggtcttccccctggcaccctcctccaagagcacctctgggggcacagcggccctgggctgcctggtcaaggactacttcctctctcgact

SEQ ID NO: 786987 - DNA, 456 bp, Homo sapiens
  misc_feature: NA.49.41.D08.9.454.heavy.3.multim50
tctgtgaagccttcacagaccctgtccctcacctgcgctgtctctggtggctccatcaccagtggtggttattcctggacttggatccggcagccaccagggaaggccctggagtggattgggcacatctatcatagtgggaccacctactacaacccgtccctccagagtcgagtcaccatatcagtcgacatgtccgagaaccagttctccctgtacctccactctgtgaccgccgcggacacggccgtctattactgtgccagaggggaactctacttcggggagttaggaatcgctcctgcatttgacatctggggccagggaaacctggtcaccgtctcctcagcctccaccaagggcccatcggtcttcccctggcaccctcctccaagagcacctctggggcacagcggccctgggctgcctggtcaaggactacttcctctctcgact

SEQ ID NO: 786988 - DNA, 444 bp, Homo sapiens
  misc_feature: NA.48.28.C06.1.454.heavy.3.multim50
catcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagatataggacttaacg

SEQ ID NO: 786989 - DNA, 563 bp, Homo sapiens
  misc_feature: NA.49.41.D08.7.454.heavy.3.multim50
actccaaggcctttccacttggtgatcagcactgagcacagaggactcaccatggagttggggctgagctgggttttccttgttgctattttagaaggtgtccagtgtgaggtgcagctggtggactcggggggaggcttggtccagcctgggggttccctgagactctcctgtgtagtctctggattcagctttaggagttattacatgagttgggtccgccaggctccagggaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgagagcacagcggccctgggctgcctggtcaaggactacttcctctctcgact

SEQ ID NO: 786990 - DNA, 323 bp, Homo sapiens
  misc_feature: NA.49.69.G03.2.454.heavy.3.multim50
ctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcrccctsctccargagcacctcygrgrgcacagcggccctgggctgcctggtcaaggactacttcctctctcgact

SEQ ID NO: 786991 - DNA, 470 bp, Homo sapiens
  misc_feature: NA.48.87.H10.4.454.heavy.3.multim50
ttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactagtggttcggggagtctccgacccacgcaactggttaccg

SEQ ID NO: 786992 - DNA, 474 bp, Homo sapiens
  misc_feature: NA.13.55.E11.1.454.heavy.3.multim50
ttgggtttggttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagataccaaccccttacgtatttttggagtta

SEQ ID NO: 786993 - DNA, 449 bp, Homo sapiens
  misc_feature: NA.48.28.C06.6.454.heavy.3.multim50
attcccaggtgtttccattcagtgatcagcactgaacacagaggactcaccatggagttgggactgagctggattttccttttggctattttaaaagctgtccagtgtgaagtgcacctggtggagtctgggggaggcttggtacagcctggcaggtccctgagactctcctgtgcagcctctggattcacctttgatgattatgccatgcactgggtccggcaagttccagggaagggcctggagtgggtctcaggcattagtagaattaggggtagcatagcctatgcggattctgtgaagggccgattcaccatctccagagacaacgccaagaactccctgtatctgcaaatgaacagtctgagacctgaggacacggccttctattactgtgcaaaagatcaggcattagactacaacggtatggacgtcgtggggccgaaggg

SEQ ID NO: 786994 - DNA, 477 bp, Homo sapiens
  misc_feature: NA.48.28.C06.7.454.heavy.3.multim50
agtgactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgtacacacaccatcttgacgactggggatgcttttcatttctggggccaggggaccgtggtcgccgtgtctacagcctccaccaagggcccatcggtccttccccctggca

SEQ ID NO: 786995 - DNA, 467 bp, Homo sapiens
  misc_feature: NA.48.28.C06.8.454.heavy.3.multim50
ctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcacgacacggctgtctattactgtgcgaggccccgagcgcagtgkckttttgtatgtcctttygrtatatgtggggtccgaagggacgaaatggtacgtaccgttccg

SEQ ID NO: 786996 - DNA, 466 bp, Homo sapiens
  misc_feature: NA.13.55.E11.3.454.heavy.3.multim50
ttgggtttggggggtctcagagaggagccttagccctggactccaaggcctttccacttggtgatcagcactgagcacagaggactcaccatggaattggggctgagctgggtgctccttgttgctattttagaaggtggccagtgtgagatgcgactggtggagtctgggggaggcttggtccagccgggggggtcactgagactctcctgtacagcctcgagattcattttcaggaattattggatgagttgggtccgccagtctccagggaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgactagttttccagacggmcgg

SEQ ID NO: 786997 - DNA, 491 bp, Homo sapiens
  misc_feature: NA.13.55.E11.4.454.heavy.3.multim50
ttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcaggggagttcgactactggggccaggggaaccctggtccaccgtctcctcacgcctccaccaacgggcyacsc

SEQ ID NO: 786998 - DNA, 478 bp, Homo sapiens
  misc_feature: NA.53.27.C05.2.454.heavy.3.multim50
agggtttgggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtggtttccatgatgcttttgatgtctggggaccgg

SEQ ID NO: 786999 - DNA, 489 bp, Homo sapiens
  misc_feature: NA.13.39.D06.2.454.heavy.3.multim50
cagttctttggggagctctgggagtggagccccagccttgggattcccaagtgtttgttttccgtgatcaggactgaacacacaggactcaccatggagttggggctgagctggattttccttcttgctatgttagaaggtgtccagtgtgaggtgcacctggtggagtctgggggaggcttggtacagcctggggggtccctgagactctcctgtgcagcctctggattcaccttcagtacctacgacatgcactgggtccgccaacctctaggaaaaggtccggagtgggtctcagggattggcagtgttggtgacacattctattcagactccgtgaagggccgattcaccatctccagagaaaatgccaacaactccttccatcttcaaatgaacagcctgagagacgggggacacggctgtgtattactgtgcaagaggggcaatttcttattactacttcgacgtctggggacaaagggaccg

SEQ ID NO: 787000 - DNA, 504 bp, Homo sapiens
  misc_feature: NA.18.14.B03.4.454.heavy.3.multim50
ttgggctgagctgggttttccttgttgctattttaaaaggtgtccagtgtgaggtgcagctggtggagtccggggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtaccacatcccctgaaagcgtcaactactactactacggtatggacctctggggccaagggaccacggtcaccgtctcctcagcctccaccaagggcccatcggtcttccccctsggcgccctgcctccagagcacctccgagagcacagcggcccgggc

SEQ ID NO: 787001 - DNA, 494 bp, Homo sapiens
  misc_feature: NA.18.14.B03.5.454.heavy.3.multim50
ttgggctgagctgggttttccttgttgctattttaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcgacccggggctcctcaatggctttcattactggggccagggaaccctagtcaccgtcgccgcagcctccaccaagggcccatcggtcttcccctggccgccctgctccaggagccacctccgagacggccctcgggctcgcctggtcaaggta

SEQ ID NO: 787002 - DNA, 488 bp, Homo sapiens
  misc_feature: NA.49.57.F02.1.454.heavy.3.multim50
ttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcagtgggatttgacttacgtgggggccaggggaaccccggtcacccgtctycctctgcctcct

SEQ ID NO: 787003 - DNA, 408 bp, Homo sapiens
  misc_feature: NA.53.27.C05.4.454.heavy.3.multim50
agggtttgggctcggggctgccctttggctttggagatggttttctcgatgggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 787004 - DNA, 594 bp, Homo sapiens
  misc_feature: NA.49.57.F02.5.454.heavy.3.multim50
ttgggtttggggctctgggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagacttttatgacagtagtggtttctccgagtatgcacattacggcatggacgtctggggccaaggggaccccggtcaccgtctccttagcctccaccaacgggcccatccggtcctttccccctggccaccctcctccaagagaccacctcgtc

SEQ ID NO: 787005 - DNA, 472 bp, Homo sapiens
  misc_feature: NA.13.23.C01.3.454.heavy.3.multim50
tagggattggggctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggaggtttggtacagccagggcggtccctgagactctcctgtataacttctggattcaacttgggtgattatgctatgaactgggtccgccaggctccagggaaggggctggagtgggtaggtttcattaggagcaattctcatgatgggacaacagaatacgccgcgtctggtaaaaggcagattcaccatctcaagagatgagtccagaagcatcgcctttctgcagatgagtagcctgaagaccgaggacacagccatctattactgtagctagagagtaattgcagtccctacggacct

SEQ ID NO: 787006 - DNA, 493 bp, Homo sapiens
  misc_feature: NA.49.24.C02.3.454.heavy.3.multim50
tagggaaaggggtctgggagaggagccccagccgtgagattcccaggagattccacttggtgatcagcactgaacacagacctccaaccatggagtttgggcttagctgcgttttccttgttgctattttaaaaggtgtccattgtgaggtgcagctggttgagtctgggggaggcttggtacagcccgggcggtccctgagactctcctgtgtaacctcaggattcatctttggtgattatggaatgacctgggtccgccaggctccagggaagggcctggagtgggtagctttcgttagcagaaagactgaaggtgggacaacagaatacggcgcgtctgtgaaaggcagatttatcatctcaagagacgattccaaaggcatcgcctatctgcaaatgaacagcctagaaaaccgaggacacagccgtgtatttttgtactagagtcttcttgttattaccatgatactagttggttttacgaggtaggc

SEQ ID NO: 787007 - DNA, 458 bp, Homo sapiens
  misc_feature: NA.49.24.C02.4.454.heavy.3.multim50
tagggaaagggggcatcatccaacgaccacatcccttctctacagaagcctctgagaggaaagttcttcaccatggactggacctggagggtcttctgcttgctggctgtagctccaggtgctcactcccaggtgcggctggtgcagtctgggtctgaggtgaagaagcctggggcctcagtgaaggtttcctgcaagacatctggatacaccttcaccaactactatatgcactgggtgcgacaggcccctggacaggggcttgagtggatggggataatcaaccctggtatcatctaccctggtcgtagtcagacaacgtacgcgcagaacttccagggcagagtcaccgtgaccgagggacacgtccacgagccacagtctatatggagctgagcagcctgagatctgaggacacgggccgtgtattactgtgcgagatccaaatactggggtaa

SEQ ID NO: 787008 - DNA, 491 bp, Homo sapiens
  misc_feature: NA.49.24.C02.5.454.heavy.3.multim50
tagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaagccgggggggtccctgagactctcctgtgcagcctctggattcaccttccgttcctataccatgaactggatccgccaggctccagggaggcgactggagtgggtctcatctattagtggtagaggtgattactaacaactacgcagactcactgggagggccgattcaccatctccagagacaacaccaagaatttactgtatctgcaawkgacagcctgagagccgacgacacggctgtctattactgtgcgagaggttcgggatattgccgtacggtccctagagtcgtccccgrcctaacg

SEQ ID NO: 787009 - DNA, 585 bp, Homo sapiens
  misc_feature: NA.49.24.C02.2.454.heavy.3.multim50
tagggaaaggggkgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagcccccagggaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaaggggaccacggtcaccgtctcctcagcctccaccaacggcccatcggtcttccccctggcaccctcctccaagagcacctctgggggcacagcggccctgggctgcctggtcaaggactacttcctctctcgact

SEQ ID NO: 787010 - DNA, 634 bp, Homo sapiens
  misc_feature: NA.52.86.H09.2.454.heavy.3.multim50
ttgggtttggggctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgtttgcaccagctgccctacccggctgctacttcgatctctgggccgtggcaccctggtcactgtcttctcagcctccaccaagggcccatcggtcttcccctgggcaccctcctccaagagcacctcybggggcacagcggccctgggctgcctggtcaaggactacttcctatacg

SEQ ID NO: 787011 - DNA, 496 bp, Homo sapiens
  misc_feature: NA.18.14.B03.2.454.heavy.3.multim50
ttgggctgagctgggttttccttgttgctattttaaaaggtgtccagtgtgaggtgcagctggtggagtccgggggaggcttgrtccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaagggcccatcggtcttccccctggcaccctcctccaagagcacctctgggggcacagcggccctgggctgcctggtcaaggactacttcccatactcgta

SEQ ID NO: 787012 - DNA, 481 bp, Homo sapiens
  misc_feature: NA.49.57.F02.8.454.heavy.3.multim50
ttgggtttgggctgagctgggttttcctcgttgctcttttaagaggtgtccagtgtcaggtgcagctggtggagtctggggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgaagaacacgctgtatctgacaaatgaaacagggctgagagctggaagacacggctgtatattactgtgcgaacttaatcacggaggacgaacggtcgaccccgtccgctcggtgcggaggtcgtggggccaagggaccacggtcagtcgtctcctcacgcctmccaccgaacgggcccagtccggtccttcccccgtc

SEQ ID NO: 787013 - DNA, 472 bp, Homo sapiens
  misc_feature: NA.49.62.F07.1.454.heavy.3.multim50
aagggaaagggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcacttatatcctatgatggaagcaataagcactacgcagagtccgtgaagggccgattgaccatctccagagacaactcgaagaatacggttcttctacaaatgaacagcctgagagctgaggacacggctatcttttactgtgcgagagggaactcgattacagcagccctacgaaacg

SEQ ID NO: 787014 - DNA, 368 bp, Homo sapiens
  misc_feature: NA.49.62.F07.4.454.heavy.3.multim50
aagggaaaggggctggagtggctttcatatatcagcagtagtggtagcaccatcttctacgcagactctgtgaagggccgattcaccatttcccgggacaacgccaagaagtcactatctctgcacatgatcagcctgagagccgaggacacggccatgtatttctgtgcgagagcccctcacggtggtgggactgtaccttattacttctacgctatggacgtctggggccaagggaccacggtcaccgtctcctcaccctccaccaagggcccatcggtcttccccctggcaccctcctccaagagcacctctgggggcacagcggccctgggctgcctggtcaaggactacttcctctctcgact

SEQ ID NO: 787015 - DNA, 335 bp, Homo sapiens
  misc_feature: NA.49.62.F07.6.454.heavy.3.multim50
aagggaaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgagagcacagcggccctgggctgcctggtcaaggactacttcctctctcgact

SEQ ID NO: 787016 - DNA, 469 bp, Homo sapiens
  misc_feature: NA.13.71.G05.2.454.heavy.3.multim50
agccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttggggccgggggaaccctgggtcaccggtcaaccg

SEQ ID NO: 787017 - DNA, 549 bp, Homo sapiens
  misc_feature: NA.51.28.C06.1.454.heavy.3.multim50
atactttctgagagtcctggacctcctgtgcaagaacatgaaacatctgtggttcttccttctcatggtggcagctcccagatgggtcctgtcccaggtgcagctgcaggagtcgggcccaggactggtgaagccttcggagaccctgaccctcacctgtactgtgtctgatgactccatcgggagttactactggacctggatccggaagcccccagggaagggactggagtggattggatatatctattataatgggaggaccgagtacaacccctccctcaagagtcgagtcaccatatcagttgactcctccaagaaccagttctccctgaggctgaactctgtgacctctgcggacacggccatgtatttctgtgcgaaagttcaggccccatcttattatgacgctagtggttatcaaataggggcctactttgactactggggccggggaacccgaggtcaccgtctcctcagcctccaccaagggcccatcggtcttccccctggccaccctcctccaagagcacctctgggggcacagcc

SEQ ID NO: 787018 - DNA, 430 bp, Homo sapiens
  misc_feature: NA.51.28.C06.4.454.heavy.3.multim50
ctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgtaaac

SEQ ID NO: 787019 - DNA, 460 bp, Homo sapiens
  misc_feature: NA.51.28.C06.5.454.heavy.3.multim50
ctctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggcttctttttactgtgcgccaggaagcagtggctggccagcakcatgcttttg

SEQ ID NO: 787020 - DNA, 585 bp, Homo sapiens
  misc_feature: NA.53.68.G02.1.454.heavy.3.multim50
tgctttctgagagtcatggacctcctgcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggtttttggactggttctcccatggaatccctactttgagtactggggccgcggagccctggtcaccgtctcctcagcctccaccaagggcccatcggtcttccccctggccaccctcctccaagagcacctctgggggcacagcggccctgggctgcctggtcaaggactacttcctcgtactgcg

SEQ ID NO: 787021 - DNA, 440 bp, Homo sapiens
  misc_feature: NA.53.68.G02.2.454.heavy.3.multim50
tgtacacctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatggacatctggggccgagggaccacggtcaccgtctcctcagcctccaccaagggcccatcggtcttcccctggcgccctgctccaggagcacctccgagagcacagcggccctgggctgcctggtcaaggactacttcctcgtactgcg

SEQ ID NO: 787022 - DNA, 454 bp, Homo sapiens
  misc_feature: NA.53.34.D01.2.454.heavy.3.multim50
ttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgacatctgacgacacgggccgtttattattgtgtgagagagggacccgatcgaccgc

SEQ ID NO: 787023 - DNA, 564 bp, Homo sapiens
  misc_feature: NA.48.26.C04.1.454.heavy.3.multim50
aacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactatggttcggggagtctccgacccagcaactggttcgaccccgtgggggccagggaaccctggtcaccgtctcctcagcctccaccaagggcccatcggtcttccccctggcaccctcctccaagagcacctctgggggcacacgg

SEQ ID NO: 787024 - DNA, 480 bp, Homo sapiens
  misc_feature: NA.48.26.C04.2.454.heavy.3.multim50
cytttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttgatgcctttgatatgtgggccgaagggacaatggtcaccgtctcttcacgcctccaccacgggacctacg

SEQ ID NO: 787025 - DNA, 482 bp, Homo sapiens
  misc_feature: NA.48.26.C04.4.454.heavy.3.multim50
ctttctgagagtcatggatctcatgtgcaagaaagtgaagcacctrtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactgggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatcgtggggccaagggacctcggtcgccggttt

SEQ ID NO: 787026 - DNA, 457 bp, Homo sapiens; identical to SEQ ID NO: 786878
  misc_feature: NA.49.34.D01.5.454.heavy.3.multim50

SEQ ID NO: 787027 - DNA, 597 bp, Homo sapiens
  misc_feature: NA.48.34.D01.2.454.heavy.3.multim50
ttgggtggggttggtggagtcggggggaggtgtggtccagcctgggaagtccctgacactgtcctgcgcagcctctggattcaccttcaccacctttcgtatgcactttgtccgccaggctccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctcggcgccctcgcctaccgaggacgccacccgtccgacgacggaccacgacggccggcccggtcggggtcgtcgccgttacgggtacgaacggtaccttacctttaccg

SEQ ID NO: 787028 - DNA, 635 bp, Homo sapiens
  misc_feature: NA.48.34.D01.3.454.heavy.3.multim50
ttgggtttggggtgggagaggagctccagccttgggactcccagctgtctccactcggtgatcggcactgaatacaggagactcaccatggagtttgggctgagctgggttttccttgttgctattttaaaaggtgtccagtgtkrggtkyrgktgsygmagtcygskggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgttacttctgaggtggacgggaaccgcgtggctagttggggccagggaaccctggtcgccgtctcctcagcctccaccaagggcccatcggtcttccccctggcgccctgctccaggagcacctccgagagcacagcggccctgggctgcctggtcaaggactactcctatgtatact

SEQ ID NO: 787029 - DNA, 597 bp, Homo sapiens
  misc_feature: NA.49.34.D01.1.454.heavy.3.multim50
ttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctggggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttacaaatgaacactctgagacgtgaggacacggctgtctattactgtgcgactgagatgtcttattacgatgccagtgctttagtaccgtttcgaccccgtcgggggtccgagggacgccckyggtccwmccggttcctccctyctagkcctttccaacccraacgggrccccgacktccggktccyttccccccgtyggccggtccccg

SEQ ID NO: 787030 - DNA, 596 bp, Homo sapiens
  misc_feature: NA.49.34.D01.4.454.heavy.3.multim50
ttgggtttgggggggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagacttttatgacagtagtggtttctccgagtatgcacattacggcatggacgtcgtggggccaagggaccccggtcaccgtctccttagcctccaccaacgggcccagtccggtcttccccccgttcggccgacccctccctccctaagagcaccctctc

SEQ ID NO: 787031 - DNA, 610 bp, Homo sapiens
  misc_feature: NA.49.34.D01.7.454.heavy.3.multim50
ttgggtttggggctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtkgrrtctkggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttgaccactgcggccagggaaccctagtcaccgtctcctcagcctccaccaagggcccatcggtcttccccctggcaccctcctccaagagcacctctgggggcacagcggccctgggctgcctggtcaaggactacttcctctctcgact

SEQ ID NO: 787032 - DNA, 488 bp, Homo sapiens
  misc_feature: NA.49.34.D01.8.454.heavy.3.multim50
ttgggtttgggggatttgggggcaatttatgaacccgaaaggacatggccatggggtgggtagggacagtagggacagatgtcagcctgaggtgaagcctcaggacacaggtgggcatggacagtgtccacctaagcgagggacagacccgagtgtccctgcagtagacctgagagcgctgggcccacagcctcccctcggggccctgctgcctcctcaggtcagccctggacatcccggctttccccaggcctggcggtaggtttgaagtgaggtctgtgttcactgtggtcttactatgatagtagtggttatattagcagccactcagcacattcggctactggggccagggaaccctggtcaccgtctcctcagcctccaccaagggcccatcggtcttccccyyggcaccctcctccaagagcacctctgggggcacagcggccctgggctcgcctggtcaaggactacttcctctctcgact

SEQ ID NO: 787033 - DNA, 485 bp, Homo sapiens
  misc_feature: NA.49.78.H01.2.454.heavy.3.multim50
acccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgacttactgggggccagggggaaccccggtcgacccgtctcccgtctgccctccaccgaacc

SEQ ID NO: 787034 - DNA, 560 bp, Homo sapiens
  misc_feature: NA.49.78.H01.4.454.heavy.3.multim50
agaggagcccagcactgggattccgaggtgtttccattcagtgatctgcactgaacacagaggactcgccatggagtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaagggcccatcggtcttcccctggcgccctgctccaggagcacctccgagagcacagcggcccg

SEQ ID NO: 787035 - DNA, 485 bp, Homo sapiens
  misc_feature: NA.49.78.H01.5.454.heavy.3.multim50
acggtgttttcgagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgacaaaagattacggtgaccacaccttattttcgacctactgcggccaac

SEQ ID NO: 787036 - DNA, 474 bp, Homo sapiens
  misc_feature: NA.48.55.E11.7.454.heavy.3.multim50
ttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagaggtaagggttttactagttgggttcggggagtcctccgacccagcaactggttcccg

SEQ ID NO: 787037 - DNA, 282 bp, Homo sapiens
  misc_feature: NA.49.10.A10.3.454.heavy.3.multim50
agggtcttcgtggctcacgtccaccaccacgcatgtgacctcaggggtccgggagatcatgagggtgtccttgggttttggggggaagaggaagactgacggccccccctttcaggagcgatcatactactttgaccactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 787038 - DNA, 463 bp, Homo sapiens
  misc_feature: NA.48.87.H10.3.454.heavy.3.multim50
ttgggtttgggggctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcggatttcacctacacacg

SEQ ID NO: 787039 - DNA, 423 bp, Homo sapiens
  misc_feature: NA.51.5.A05.2.454.heavy.3.multim50
aggggaccttcctgccagacaccaccaggggccctcctggaagggacaggagcgcgcaagggtgagtcagaccctcctgccctcgatggcaggtggagaagattcagaaaggtctgagatccccgggacgcagcaccactgtcaatggggggccccagacgcctggaccagggcctgcgtgggaaaggcctctgggcacactcaggggctttttgtgaagggtccgcctactgtgtgactacggtaaatacgttaattcttctactacgatatggacgtctggggccaagggaccacggtcaccgtctcttcagcctccaccaagggcccatcggtcttccccctggcaccctcctccaagagcacctctgggggcacagcggccctgggctgcctggtcaaggactacttcctcgtagcact

SEQ ID NO: 787040 - DNA, 454 bp, Homo sapiens
  misc_feature: NA.13.71.G05.6.454.heavy.3.multim50
agccttagccctggactccaaggcctttccacttggtgatcagcactgagtacagaggactcaccatggaattggggctgagctgggttttccttgttgctattttagaaggtgtccagtgtgaggtgcagctgacggagtctggaggagacttggtccagccgggggggtccctgagactctcctgcatagtctcaagatttatgttcagtaattattggatgagctgggtccgccaggctccagggaaggggctggagtgggtggccaacataaagcacgatggaagtgagaaacagtatgtggagtctgtgaagggccgattcaccatctccagagacaacgccaagaactcactgtatctgcagatgagcagcctgagaggcgaggacacggctgtatattactgtgcgagggaagtattttactctgatagtagtggttactacctccg

SEQ ID NO: 787041 - DNA, 428 bp, Homo sapiens
  misc_feature: NA.49.27.C05.6.454.heavy.3.multim50
aggggtccgggagatcatgagggtgtccttgggttttggggggaagaggaagactgacggtccccccaggagttcaggtgctgggcacggtgggcattggtgactcatgtggaagacagaaaattgtacgcagactccgtgaggggccgattcatcatctccaaagactactccaagaatacggtgtatcttcaaatgaatggcctcgtttttgcggacacggctgtttattattgtgcgacagggggcccccctttccaggagcgatcatactactttgaccactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 787042 - DNA, 461 bp, Homo sapiens
  misc_feature: NA.48.23.C01.2.454.heavy.3.multim50
tagggattggggacccaacaaccacatccctcctcagaagcccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaagacacggcagtatattactgtgcgagaggcggatattgtcgtcgaggtgactgctacagtacaaaatcgtgtac

SEQ ID NO: 787043 - DNA, 378 bp, Homo sapiens
  misc_feature: NA.13.23.C01.5.454.heavy.3.multim50
tagggattgggtgcgacaggctcctggacaagggcttgagtggatgggatggatcgacatcaacactgggaacccaacgtatgcccagggcttcacaggacggtttgtcttctccttggacacctctgtcagcacggcgtatgtacagatcagcagcctaaaggctgaggacactgccatttattactgtgtgagagattctttccttgactacggtacttctgtccttgactactggggccagggaaccctggtcagcgtctcctcagcctccaccaagggcccatcggtcttccccctggcgccctgctccaggagcacctccgagagcacagcggccctgggctgcctggtcaaggactacttcctagtacgtga

SEQ ID NO: 787044 - DNA, 491 bp, Homo sapiens
  misc_feature: NA.51.37.D04.6.454.heavy.3.multim50
ttgggtttggggagctctgagagaggagcccagccctgggattttcaggtgttttcatttggtgatcaggactgaacagagagaactcaccatggagtttgggctgagctggctttttcttgtggctattttaaaaggtggccagtgtgaggtgcagctgttagagtctgggggaggcttggtccagcctggggggtccctcagactctcctgtgcagcctcgggaattatatttaagaactttgccatgagttgggtccgccaggctccagggaaggggctggaatgggtctccactattagtggcagcggtgatgacacattctacacagactccgtgaggggccgtttcaccatctccagagacaatgccaaagacacgctctatctggaagtgaaagagcctgagagtcgaggacacggccgtcttttattgtgtgaaggggcgtgggacttagttcttcaggaccagtatttactttgtacytctc

SEQ ID NO: 787045 - DNA, 462 bp, Homo sapiens
  misc_feature: NA.49.23.C01.3.454.heavy.3.multim50
tagggattggggtctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcryctyyagkgtctaysmyatgcactgggtccgccaggctccaggcaaggggctggartggggtggcasttatastcatmtgatggaagcaagatatactayrtwgactccgtgaagggccgattcatcatctccagagacaactccgagaacacrctgtatctkcaaatgaacaggytgagagctagaagacacggctgtaatattactgtgcgaaacttaatcacggaggaaccg

SEQ ID NO: 787046 - DNA, 471 bp, Homo sapiens
  misc_feature: NA.49.53.E09.3.454.heavy.3.multim50
ttgggtttggggacccaacaaccacatccctcctcagaagcccccagagcacaacgcctcaccatggactggacctggaggatcctctttttggtggcagcagccacaggtgcccactcccaggtccaacttgtgcagtctggggctgagttgaagaagcctggggcctcagtgaaggtttcctgcacggtttctggataccccctcagcagtcatgctatgcattgggtgcgccaggcccccggacaaaggtttgagtggatgggatggatcaccgctggcaatggtgacacaaaatattcacaaaagttccagggcagagtcaccatttacagggacacatctgcgagttcaggctacatggaactgagcggcctgagatatgaggacacggctatttattactgtgcgagagggaaatgggatattgtgtcagctccaggtgcccagcccggcccctactttgtacrv

SEQ ID NO: 787047 - DNA, 338 bp, Homo sapiens
  misc_feature: NA.13.46.E02.2.454.heavy.3.multim50
ctgcagtgggtctctggtataaactggaatggtgccagcacaacttatgcagactctgtgaagggccgattcaccatctccagagacagtgccgagaactccgtacatctgcaaatgaacagtctcggagtcgaggacacggccttgtatttctgtgcgaggttagcagtggctggtacttacgcaatggacgtctggggccaagggaccacggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 787048 - DNA, 472 bp, Homo sapiens
  misc_feature: NA.52.35.D02.7.454.heavy.3.multim50
ttgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtggatggggtggaacaatcccaacagtggaggcaccggtcgcacagaatatgcgcggaagtttcagggcagggtcaccatgaccagcgacaggtccactaacacagcctacatggagctaagtagactgacatctgacgacacggccgtctattattgtgtgagagaggacccgatgacctcgaacatggacgtctggggccg

SEQ ID NO: 787049 - DNA, 442 bp, Homo sapiens
  misc_feature: NA.52.35.D02.12.454.heavy.3.multim50
ttgggtttggggagctctgggagaggagcccagcactagaagtcggcggtgtttccattcggtgatcagcactgaccacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcaatagctatggcatgcactgggtccgccaggctccaggcaaggggctgaggtgggtggccagtatgtcatatggtggacttaatgcatactatgcagactccgtgaagggccgattcatcatctccagagacaattccaagaacacgctgtatctgcaaatgaacagcctgagagctgaggacacggctgtgtatttactgttgacg

SEQ ID NO: 787050 - DNA, 467 bp, Homo sapiens
  misc_feature: NA.48.29.C07.3.454.heavy.3.multim50
agggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtcttcc

SEQ ID NO: 787051 - DNA, 561 bp, Homo sapiens
  misc_feature: NA.49.37.D04.5.454.heavy.3.multim50
ttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcgaacggtcgtcatgggatttgactacgtggggccaggggaaccccggtcaccggtctcctctgcctcccrccragggcccatcggtcttcccctggcaccctcctccaacgagcacctctgggggcacagcggccctgggctcgg

SEQ ID NO: 787052 - DNA, 344 bp, Homo sapiens
  misc_feature: NA.18.60.F05.1.454.heavy.3.multim50
gggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattggggccggggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 787053 - DNA, 426 bp, Homo sapiens
  misc_feature: NA.48.59.F04.2.454.heavy.3.multim50
tagggattgggtagggattggggcagggtgtacacctgtggttctcggggctgccctttggctttggagatggttttctcgatgggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtgggrccaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 787054 - DNA, 497 bp, Homo sapiens
  misc_feature: NA.18.59.F04.2.454.heavy.3.multim50
tagggattggggctgggagaggagccccagccttgggattcccaagtgttttcattcagtgatcaggactgaacacagaggactcaccatggagtttgggctgagctggattttccttgytgctattttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgtacccctgggggcccgggggaaccctggtcaccgtctcccccaccctccaccg

SEQ ID NO: 787055 - DNA, 502 bp, Homo sapiens
  misc_feature: NA.49.29.C07.3.454.heavy.3.multim50
agggaaaggggtctgggagacgagcccagcactggaagtcgccggagggaaaggggggtgatcatcactgaacacagaggactcaccatggagtttgggctgagctgggttttcctcgttgctcttttaagaggtgtccagtgtcaggtgcttctggtggactctgggggaggcgtggtccggcctgggaggtccctgagactctcctgtgcagcctctcagttcaccttcagtgtctatactatgcactgggtccgccaggctccaggcaaggggctggagtgggtggcacttatatcaaatgatggaagaattcaacactacgcaggctccgtgaagggccgattcaccatctccagagacaattccaagaacacactgtctctgcaaatgaatagcctgagagttgaggacacggctgtctattactgtgcgagagcgtaagggacttactcatagatttgtactactggagccagggagcctgtcaccgtcctcctca

SEQ ID NO: 787056 - DNA, 459 bp, Homo sapiens
  misc_feature: NA.52.37.D04.2.454.heavy.3.multim50
ttgggtttgggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctggggggggctggtccagcctgggaggtccctgagactctcctgtgcaggctctgcatttcccttcagtaactatgctatcgattgggtccgccaggctccaggcaagggactggagtgggtggcagttatatcagctgatggaggcagtaaatattacgcagattctgcgaggggccgattcaccatatccagagacaactacccaagatatgatatatctaacaaatagaacagcctgagacctgaggacacggctgtatattattgtgcgtcgagggggcaggtgtccg

SEQ ID NO: 787057 - DNA, 444 bp, Homo sapiens
  misc_feature: NA.52.45.E01.3.454.heavy.3.multim50
ctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactgggtccgccaggctccaggcaaggggctggagtgggtggcagttatatcatatgatgggaagtaagatatactatgcagactccgtgaagggccgattcaccatttccagagacaactccaagaacacgctgtatttgcaaatgaacagcctgagagctgaggacacggctgtgtattactgtgcgaacttaatcacggaggaacg

SEQ ID NO: 787058 - DNA, 461 bp, Homo sapiens
  misc_feature: NA.51.34.D01.4.454.heavy.3.multim50
ttgggtttgggggggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctggggggggsctggtccagcctgggaggtccctgagactctcctgtgcaggctctgcatttcccttcagtaactacgctatcgattgggtccgccaggctccaggcaagggactggagtgggtggcagttatttcagctgatggaggcaataagttttacggagattctgcgaggggccrattcaccatatccagagacaactcccaagatatgatatatctgcaaatgaacagcctgagacctgaggacacggctatgtattattgtgcgtcgagggggcaggtgccgtggccacgtg

SEQ ID NO: 787059 - DNA, 461 bp, Homo sapiens
  misc_feature: NA.49.82.H05.1.454.heavy.3.multim50
agctctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccagggaagggactggagtgggtttcatacattagtcggagagtcaacaccgtattctacacagactctgtgaggggccgattcaccatctccagagacaacgccaagaactcactgtatctccaaatgaacagcctgagagtcgaggacacggctgtctattactgtgcgagagatcccaacagcggctggtactttgactacg

SEQ ID NO: 787060 - DNA, 478 bp, Homo sapiens
  misc_feature: NA.49.45.E01.1.454.heavy.3.multim50
tctgggagaggagccccagccgtgagattcccaggagattccacttggtgatcagcactgaacacagacctccaaccatggagtttgggcttagctgcgttttccttgttgctattttaaaaggtgtccattgtgaggtgcagctggttgagtctgggggaggcttggtacagcccgggcggtccctgagactctcctgtgtaacctcaggattcatctttggtgattatggaatgacctgggtccgccaggctccagggaagggcctggagtgggtagctttcgttagcagaaagactgaaggtgggacaacagaatacggcgcgtctgtgaaaggcagatttatcatctcaagagacgattccaaaggcatcgcctatctgcaaatgaacagcctagaaaaccgaggacacagccgtgtatttttgtactagagtcttcttgtattaccatgatactagtggttttacaggtaggc

SEQ ID NO: 787061 - DNA, 446 bp, Homo sapiens
  misc_feature: NA.51.27.C05.3.454.heavy.3.multim50
agggtttggggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgacgaacttaa

SEQ ID NO: 787062 - DNA, 457 bp, Homo sapiens
  misc_feature: NA.52.68.G02.2.454.heavy.3.multim50
ctgggagacgagcccagcactggaaggcgccggtgtttccattcggtgatcagcactgaacacagaggactcaccatggagtttgggctgagctgggttttcctcgttgctcttttaagaggtgtccagtgttatgtgcagctggtggagtctgggggaggcgtggtccagcctggcaggtcactgagactcgcctgtacaccctctggattcaccttcagcaactatgctatgcactgggtccgcctggctcccggcaagggtctggactgggtggcaggtatatcagctgatgggaccaaaaatactacgcaaactccgtgaagggccgattcaccatatcaagagacagttccgatgacacagtctatctgcaaatgaacagcctgaaagttgacgacacgggtctttttactgttgcgcctggaagcagtggctggccacatgatgcttttga

SEQ ID NO: 787063 - DNA, 433 bp, Homo sapiens
  misc_feature: NA.49.78.H01.7.454.heavy.3.multim50
agctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgtaamtt

SEQ ID NO: 787064 - DNA, 473 bp, Homo sapiens
  misc_feature: NA.49.78.H01.8.454.heavy.3.multim50
ctctgggagaggagcccagcactagaagtcggcggtgtttccattcggtgatcagcactgaacacagaggactcaccatggagtttgggctgagctgggttttcctcgttgctcttttaagaggtgtcctttgtcgggtgcagttgrtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagtacttttatgacagtagtggtttctccgagtatgcacattacgg

SEQ ID NO: 787065 - DNA, 551 bp, Homo sapiens
  misc_feature: NA.49.78.H01.9.454.heavy.3.multim50
aatgactctagaagtctcccacatctgacctttctgggtggaggcaggtggtggccmwgaggaakactramrrtcccyccagratgwtsagstgctgkgmwykgtgggcaacttatgagcccgaaaggacatggccacggggtgggtagggacatagggccagatgccagcctgaggtggagcctcaggtcacaggtgggcacggacactatccacataagcgagggatagacccgagtgtccccacagcagacctgagagcgctgggcccacagcctccccctcacgagccctgctgcctcctcccggtcagcccctggacatccccaggtttcccccaggccctggcggtaggtttagaatgaggtctgtgtcactgtggtattacgatattttgactggtttggatgactcttacttctacttctacgttatggacctctggggscaagggaccacggtcaccgtcyyctcagcctccaccaagggcccatcggtcttcccctggcaccctcctccaagagcacctctgggggcacagcggccctggg

SEQ ID NO: 787066 - DNA, 474 bp, Homo sapiens
  misc_feature: NA.40.35.D02.1.454.heavy.3.multim50
ttgggtttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgattgcctttgattatggtggggccgaaggggacaagtggtcaccgttccg

SEQ ID NO: 787067 - DNA, 353 bp, Homo sapiens
  misc_feature: NA.49.58.F03.3.454.heavy.3.multim50
aagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 787068 - DNA, 624 bp, Homo sapiens
  misc_feature: NA.40.35.D02.3.454.heavy.3.multim50
ttgggtttgggtctgagagaggagcccagccctgggactttcaggtgttttcatttggtgatcaggactgaacagagagacctcaccatggactttgggctgaggtggctttttcttgtggctcttttaaaaggtgtccagtgtgaggtgcagttattggagtcggggggaggcttaatacagccgggggggtccctgagactcgcctgtattgggtttgggattcacgttgcagatgtagggctgggtccgccaggctgcagggaaggggctggaatgggtctctattattagtggtaggacagatagtcgaaactacgctgactccgtgaagggccgcttcaccatctccagagacgtttccaacaacacgatctttctggagatgaatagcctgagagccgaggacacggccaaatattactgtgcgaaaagaaccctctattgtagtggtggaagttgtaactactactttgattcctggggccagggaaccctggtcaccgtctcctcagcctccaccaagggcccatcggtcttccccctggcaccctcctccaagagcacctctgggggcacagcggccctgggctgcctggtcaaggactacttccagtcgctaga

SEQ ID NO: 787069 - DNA, 563 bp, Homo sapiens
  misc_feature: NA.49.38.D05.1.454.heavy.3.multim50
ttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactacgtggggccgaggggaaccccggtcgaccgtctcctctcgcctccaaccrasgccatcgtcttcccctcggccaccctcctccaacgagcacctctgggggcacgagcggccctcgggcgtcg

SEQ ID NO: 787070 - DNA, 608 bp, Homo sapiens
  misc_feature: NA.49.38.D05.2.454.heavy.3.multim50
ttgggtttgggggggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagacttttatgacagtagtggtttctccgtagtatgcacattacggcatggacgtcgtgggggccaaggggaccccggtcgacccgtccttcccttagcccttcccacccaacggggccccatccggtccgttccccctcggccacccctcctcccaagacgcaccctccgtc

SEQ ID NO: 787071 - DNA, 474 bp, Homo sapiens
  misc_feature: NA.51.35.D02.3.454.heavy.3.multim50
ttgggtttggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcacgcctacggaagaa

SEQ ID NO: 787072 - DNA, 560 bp, Homo sapiens
  misc_feature: NA.49.38.D05.4.454.heavy.3.multim50
ttgggtttggggtctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaacggcccatcggtccttccccctyggccgcccg

SEQ ID NO: 787073 - DNA, 634 bp, Homo sapiens
  misc_feature: NA.49.38.D05.6.454.heavy.3.multim50
ttgggtttggggtctgagagaggagcccagccctgggattttcaggtgttttcatttggtgatcaggactgaacagagagaactcaccatggagtttgggctgagctggctttttcttgtggctactttaaaaggtgtccagtgtgacgtccaactggtkgrgtytgggggaggcttggtgcagcctggggggtccctgagactctcctgtgtagcctctgagttcacctttagagtctatgccatgagttgggtccgccaggctccagggaaggggctgggagtgggtctcaggtatcagtggtaatgatggtaacacaaactatgcagactccgtgaagggccggttcaccatctccagagacaattccaagaatatgctatttctgcaaatgaacagcctgagaatcgaggacacggccgtatattactgtgtgaaagaagatggaccgctggacgaggagccctacggcgggtcctactttgactactggggccggggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 787074 - DNA, 468 bp, Homo sapiens
  misc_feature: NA.49.38.D05.7.454.heavy.3.multim50
ttgggtttggggagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactaccctgtatctgcaaatgaacagtctcagaggtgaggacaccgccttctactactgtgcaaaagattacggtgaccacacctattttga

SEQ ID NO: 787075 - DNA, 511 bp, Homo sapiens
  misc_feature: NA.48.14.B03.2.454.heavy.3.multim50
tccgcgggcacgaccggtgctcgatttagtagtgtagattcgcggggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggakrtggacggagctcggttttcggagtttatcatctactactttgaattc

SEQ ID NO: 787076 - DNA, 454 bp, Homo sapiens
  misc_feature: NA.51.35.D02.1.454.heavy.3.multim50
ttgggtttgggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 787077 - DNA, 611 bp, Homo sapiens
  misc_feature: NA.51.35.D02.2.454.heavy.3.multim50
ttgggtttggggtctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggcttctttttactgtgcgccaggaagcagtggctggccacatcatgtcttttgatatctggagccaagggacaatggtcatcgtctcttcggcctccaccaagggcccatcggtcttcccctggcaccctcctccaagagcacctctgggggcacagcggccctgggctgcctggtcaaggactacttcctcg

SEQ ID NO: 787078 - DNA, 486 bp, Homo sapiens
  misc_feature: NA.51.35.D02.5.454.heavy.3.multim50
ttgggtttgggcacgaccggtgctcgatttagagtatacatattgggtttgggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttatcaac

SEQ ID NO: 787079 - DNA, 489 bp, Homo sapiens
  misc_feature: NA.51.35.D02.6.454.heavy.3.multim50
ttgggtttggggagctctgagagaggagcccagccctgggattttcaggtgttttcatttggtgatcaggactgaacagagagaactcaccatggagtttgggctgagctggctttttcttgtggctattttaaaaggtggccagtgtgaggtgcagctgttagagtctgggggaggcttggtccagcctggggggtccctcagactctcctgtgcagcctcgggaattatatttaagaactttgccatgagttgggtccgccaggctccagggaaggggctggaatgggtctccactattagtggcagcggtgatgacacattctacacagactccgtgaggggcccgtttcacccatctccagagacaatgccaaagacacgctctatctggaagtgaagagcctgagagtcgaggacacggccgtyytttattgtgtgaaggggcgtggggactttattcttcaggaccatatttactttgtaccg

SEQ ID NO: 787080 - DNA, 462 bp, Homo sapiens
  misc_feature: NA.51.87.H10.1.454.heavy.3.multim50
ttgggtttggggacccaaaaaccacacccctccttgggagaatcccctagatcacagctcctcaccatggactggacctggagcatccttttcttggtggcagcagcaacaggtgcccactcccaggttcagctggtacagtctggagctgaagtgaagaagcctggggcctcagtgaaggtctcctgcaaggcctctggttacacctttatgaattatggtatcagctgggtgcgccaggcccctggacaagggcttgagtggatgggatggatcagcgcttacactggtgacacaaagtatgcacagaaactccagggcagagtcaccatgaccacagacacgtccacgagcacagcctacatggaactgaggagcctgggatctgacgacacggccgtgtattactgtgcgagagataggccccaggggagagtagtggttttcaccggctggcattgt

SEQ ID NO: 787081 - DNA, 578 bp, Homo sapiens
  misc_feature: NA.51.87.H10.2.454.heavy.3.multim50
ttgggtttgggggctctgggagacgagcccagcactggaagtcgccggtgtttccattcggtgatcatcactgaacacagacattgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgmcaacggtatggacgtctggggccgaagggaccacggtcaccgtctccttagcctccaccaagggcccatcggtcttccccctsgscaccctcctccaagacgcacctcg

SEQ ID NO: 787082 - DNA, 469 bp, Homo sapiens
  misc_feature: NA.51.87.H10.3.454.heavy.3.multim50
ttgggtttggggakytskgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggcccttgtattactgcgmmaaagccaaggccaacagctggtactact

SEQ ID NO: 787083 - DNA, 394 bp, Homo sapiens
  misc_feature: NA.9.30.C08.2.454.heavy.3.multim50
aagggaaagggtctgtgaagccttcacagaccctgtccctcacctgcactgtctctggtgactccatcaccggtactaattactactggagttggatccgccagccccccgggaagggcctggagtggattggatacgccttttacagtggagtcacctactacaaccaaagggcagccccgagaaccacaggtgtacaccctgcccccagaacgcaaagcagcgcctactatactttaaactttgacttctggggccagggatccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 787084 - DNA, 617 bp, Homo sapiens
  misc_feature: NA.52.33.C11.1.454.heavy.3.multim50
ttgggtttggggagctctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccgagggggcgggagcacgccccgtaacttctggggccagggaacccgggtcaccgtctcctcagcctccaccaagggcccatcggtcttccccctggcaccctcctccaagagcacctctgggggcacagcggccctgggctgcctggtcaaggactacttcctatacgatcg

SEQ ID NO: 787085 - DNA, 534 bp, Homo sapiens
  misc_feature: NA.52.33.C11.2.454.heavy.3.multim50
ttgggtttgggctgagctggctttttcttgtggctattttaaaaggtgtccagtgtgaggtgcaactgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttccccctggcaccctcctccaagagcacctctgggggcacagcggccctgggctgcctggtcaaggactacttcctatacgatcg

SEQ ID NO: 787086 - DNA, 639 bp, Homo sapiens
  misc_feature: NA.52.33.C11.6.454.heavy.3.multim50
ttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcgtggtacagcctggcgggtccctgagactctcctgtgcagcctctggattcagctttgatgagtatgccatgcactgggtccggcaggctccagggaagggcctggagtgggtctcaggtattagttggactagtggtagtataggctatggggcctctgtgaagggccgattcaccatctccagagacaacgccaagaactccctgtctctgcaaatgaacggactgagagttgaggacacgggcttctactattgtgcaaaaggccctgcccttttctatgatatcactgcttattactacacgccggttgactcctggggccagggaaccctggtcaccgtctcctcagcctccaccaagggcccatcggtcttcccctggcaccctcctccaagagcacctctgggggcacagcggccctgggctgcctggtcaaggactacttcctatacgatcg

SEQ ID NO: 787087 - DNA, 501 bp, Homo sapiens
  misc_feature: NA.52.33.C11.7.454.heavy.3.multim50
ttgggtttggggggctctgggagaggagcccagcactgggattccgaggtgtttccattcagtgatctgcactgaacacagaggactcgccatggagtttgggctgagctgggttttccttgttgctattttaaaaggtgtccagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccagtccggtccttccccckyggccacccctccctccaaagacgcaccctcgtc

SEQ ID NO: 787088 - DNA, 510 bp, Homo sapiens
  misc_feature: NA.48.82.H05.1.454.heavy.3.multim50
cacgaccggtgctcgatttagtcgagctctctcgcgggcacgaccggtgctcgatttagtgacacwcacgtagggwttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatcgtcctttcgtatatt

SEQ ID NO: 787089 - DNA, 283 bp, Homo sapiens
  misc_feature: NA.18.17.B06.1.454.heavy.3.multim50
agggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 787090 - DNA, 505 bp, Homo sapiens
  misc_feature: NA.48.9.A09.1.454.heavy.3.multim50
agggcacgaccggtgctcgatttagtacacacacttagggatagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttgatgcctttgatatgtggggccgaagggacaatggtcaccgtcttccg

SEQ ID NO: 787091 - DNA, 497 bp, Homo sapiens
  misc_feature: NA.48.9.A09.2.454.heavy.3.multim50
aggggcagggtgtacacctgtggttctcggggctgccagggggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactactggggctggatccgccagtccccagggaaggggctggagtggattggaattatctattatagcgggagcacctactataatccgtccctcaagagtcgagtcaccatatccgtagacacatccaagaaccagttctccctgaggctgagccctgtgaccgccgcagacacggctgtctattactgtgcgacccatcgatatcatgactggttgttagggcacgtctggggccaagggaccacggtcaccgtctcctcg

SEQ ID NO: 787092 - DNA, 490 bp, Homo sapiens
  misc_feature: NA.49.27.C05.1.454.heavy.3.multim50
agggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactgggggccaggggaaccccggtcaccggtctcctctcgcctccaccgaac

SEQ ID NO: 787093 - DNA, 526 bp, Homo sapiens
  misc_feature: NA.49.27.C05.3.454.heavy.3.multim50
agggggctctgggagacgagcccagcactggaagtcgccggtgtttccattcggtgatcatcactgaacacagaggactcaccatggagtttgggctgagctgggttttcctcgctgctcttttaagagacgtccactgttttgtgggcctggtggagtctggggggggsctggtccagcccgggaggtccctcagactctcctgtacagacccgacatcttacgtcaggattaataatgtacactggatccgccaggccccaggcaaggggctggagtgggtggcattggtgactcatgtggaagacagaaaattgtacgcagactccgtgaggggccgattcatcatctccaaagactactccaagaatacggtgtatcttcaaatgaatggcctcgtttttgcggacacggctgtttattattgtgcgacgacggggggcccccctttccgtacggaggcggagtcatactwactttcgtaccacstcggggbccgacgggaacccgtcgggtaccgtccgtt

SEQ ID NO: 787094 - DNA, 630 bp, Homo sapiens
  misc_feature: NA.49.27.C05.5.454.heavy.3.multim50
agggtttgggggacgagcccagcactggaagtcgccggtgtttccattcggtgatcatcactgaacacagaggactcaccatrgrgtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgaccccgtggggccgagggacgcccgtggtccaccgtctcctccagcttcccaccaacgggcccatccggtccttcccctggccgccyygctccaggagcacctctgggggcacagcggccctgggctgcctggtcaaggactacttcctctctcgactc

SEQ ID NO: 787095 - DNA, 655 bp, Homo sapiens
  misc_feature: NA.48.55.E11.2.454.heavy.3.multim50
ttgggtttggggaggtctcagagaggagccttagccctggactccaaggcctttccacttggtgatcagcactgagcacagaggactcaccatggaattggggttgggtttgggttttccttgttgctattttagaaggtgtccagtgtgaagtgcagctggtggagtctgggggaggcttggtccagcctggggggtccctaagactctcctgtgcagcctctggattcacctttagtacctattggatgacctgggtccgccaatctccagggggggggctggagtgggtggccaatataaagggagatggaagtgtgacacactatgtggactctgtgaagggccgattcaccatctccagagacaatgccaaggagtcactgtatctgcagatgaacagcctgagagccgaggacgcggctgtgtattactgtgcgagagatgcgaatccctctgatagtaatggtcgttattatgatgcttttgatatgtggggccaagggacaacggtcaccgtctcttcagcctccaccaagggcccatcggtcttcccctcggccgccctgctccaggacgcacctccgagacgcacacgcggcccgtgggcgtcgccgtcggtcgaaggtaccttacttcctattgtactacttcg

SEQ ID NO: 787096 - DNA, 454 bp, Homo sapiens
  misc_feature: NA.48.55.E11.3.454.heavy.3.multim50
ttgggtttgggggatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctatttattgttccagagataatcgcgtagaataaagatatrgactaa

SEQ ID NO: 787097 - DNA, 473 bp, Homo sapiens
  misc_feature: NA.48.55.E11.6.454.heavy.3.multim50
ttgggtttggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttagattatgttgggggccaaggggacaagtggtcaccgtctcttcagcctccaccaaggg

SEQ ID NO: 787098 - DNA, 527 bp, Homo sapiens
  misc_feature: NA.49.10.A10.1.454.heavy.3.multim50
aggggagskctgggagacgagcccagcactggaagtcgccggtgtttccattcggtgatcatcactgaacacagaggactcaccatggagtttgggctgagctgggttttcctcgctgctcttttaagagacgtccactgttttgtgggcctggtggagtctggggggggcgtggtccagcccgggaggtccctcagactctcctgtacagacccgacatcttacgtcaggattaataatgtacactggatccgccaggccccaggcaaggggctggagtgggtggcattggtgactcatgtggaagacagaaaattgtacgcagactccgtgaggggccgattcatcatctccaaagactactccaagaatacggtgtatcttcaaatgaatggcctcgttttgcggacacggctgtttattattgtgcgacgagggggcccccctttccgtacggaggcgagtcatactactttacgtacctactcggggccgacggggaacccgtacggtaccgaccggtcccg

SEQ ID NO: 787099 - DNA, 452 bp, Homo sapiens
  misc_feature: NA.48.87.H10.1.454.heavy.3.multim50
ttgggtttggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagatatggactaa

SEQ ID NO: 787100 - DNA, 476 bp, Homo sapiens
  misc_feature: NA.48.87.H10.6.454.heavy.3.multim50
ttgggtttgggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcacttgtctctggtggctccatcagcagcagtacttacttctggggctggatccgccagcccccagggaaggggctggagtggattggggagtatttaccacagtgggagcacctactacaacccgtccctcaaaagtcgaggcaccatatccgtagacacgtccaagaaccaattctccctgaagctgagctctgtgaccgccgcacgacacggctgtctattactgtgcgaggccccgagcgcagtggcttttgatgccttgatatgtggggccaagggacaatggtactaccgtctcttcagtcctccaccamsggacccg

SEQ ID NO: 787101 - DNA, 459 bp, Homo sapiens
  misc_feature: NA.48.87.H10.7.454.heavy.3.multim50
ttgggtttggggaggtctcagagaggagccttagccctggactccaaggcctttccacttggtgatcagcactgagcacagaggactcaccatggaattggggctgagctgggtttttccttgttgctattttagaaggtgtccagtgtgaagtgcagctggtggagtctgggggaggcttggtccagcctggggggtccctaagactctcctgtgcagcctctggattcacctttagtacctattggatgacctgggtccgccaatctccagggggggggctggagtgggtggccaatataaagggagatggaagtgtgacacactatgtggactctgtgaagggccgagttcaccatctccagagacaatgccaaggagtcactgtatctgcagatgaacagcctgagagccgaggacgcggctggtgtattactgtgcgagagatggcgaactccc

SEQ ID NO: 787102 - DNA, 491 bp, Homo sapiens
  misc_feature: NA.48.87.H10.8.454.heavy.3.multim50
ttgggtttggggagtgactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgttacacacaccatcttgacgactggggatgcttttcatttctggggccaggggaccgtggtcgccgtgtctacagcctccaccaagggcccatcggtcttcccctctggcca

SEQ ID NO: 787103 - DNA, 473 bp, Homo sapiens
  misc_feature: NA.13.71.G05.1.454.heavy.3.multim50
tcaaccgccatccttgccctcctcctggctgttctccaaggagtctgtgccgaggtgcagctggtgcagtctggagcagaggtgaaaaagcccggggagtctctgaagatctcctgtaagggttttggaaacagctttatcagccactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcaaaatacgcatactacggtaattcaccggcttactactacaacggtatggacgtctggggccaagggacccacggtcaccgtctcctcagcctccaccaagggcccatcggtccttycccctggcctacccc

SEQ ID NO: 787104 - DNA, 470 bp, Homo sapiens
  misc_feature: NA.13.71.G05.4.454.heavy.3.multim50
agccttagccctggactccaaggcctttccacttggtgatcagcactgagcacagaggactcaccatggaattggggctgagctgggttttccttgttgctattttagaaggtgtccagtgtgaggtgcagctggtggagtctggggggggcttggtccagcctggggggtccctgagactctcctgtgcagcctctggattcacttttagtaggtattggatgggttgggtccgccagactccagagaagggactggagtgggtggccaacataaaggaagatggaagtgaaagatactatgtggactctgtgaagggccgattcaccatctccagagacaacgccaagaactcactgtatctgcagatgaccagcctgagagtcgaggatacggctgtgtattattgtgcgagagagtgggggcacggacatttttgtagagggtgtacgtgggggccaggggaccgg

SEQ ID NO: 787105 - DNA, 443 bp, Homo sapiens
  misc_feature: NA.13.71.G05.5.454.heavy.3.multim50
aggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaaattctatgcagactccgtgaagggccgattcaccgtctccagggacaactccaagaacaccttatatctgcagatgaacagcctgagaggtgacgactcggctgtatacttctgtgcgacaaacatgatgtttggagtggatgtgtta

SEQ ID NO: 787106 - DNA, 468 bp, Homo sapiens
  misc_feature: NA.48.35.D02.2.454.heavy.3.multim50
ttgggtttggggagctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatcctccagagacaatgccgagaactcactgtttctgcaaatgaacagcctgagagacgaggacacggcttgtttattactgtgcgagagtgcggtattttcacctacacgac

SEQ ID NO: 787107 - DNA, 573 bp, Homo sapiens
  misc_feature: NA.48.35.D02.3.454.heavy.3.multim50
ttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactatggttcggggagtctccgacccagcaactggttaccscgtgggggcccaggggaacccctggtctaccgtctcctcagcctccaccaagggcccatcggtcttccccctggcaccctcctccaagagcacctctggggcacg

SEQ ID NO: 787108 - DNA, 478 bp, Homo sapiens
  misc_feature: NA.48.35.D02.5.454.heavy.3.multim50
ttgggtttggggacccaacaaccacacccctcctaagaagaagcccctagaccacagctccacaccatggactggacctggaggatcctcttcttggtggcagcagcaacaggtgcccactcccaggtgcagttggtgcaatctgggtctgatttgaagaagcctggggcctcagtgaaggtttcctgcagggcttctggatactccttcactgactatggtatcaattgggtgcgacaggcccctggccaagggcttgagtggatggggtggatcgacaccaacactgggaacccaacacatgcccggggcttcaaaggacggtttgacttctccttggccacctctgtcagcacggcatatctgcagatcagcagcctaaagcctgaggacactgccgtgttttattgtgcgagatccaggcgagggaggataccgattcttatatagcgactactactactttcggaatggtacg

SEQ ID NO: 787109 - DNA, 514 bp, Homo sapiens
  misc_feature: NA.48.35.D02.6.454.heavy.3.multim50
  modified_base (500)..(500): a, c, t, g, unknown or other
ttgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaaggggacctccggtcgtcccgtttcncagcctcaccaagg

SEQ ID NO: 787110 - DNA, 500 bp, Homo sapiens
  misc_feature: NA.48.35.D02.7.454.heavy.3.multim50
ttgggtttgggggctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttcgaccccgtggggccagggactaccgtggtcacccggtccgttccctccgacgccttt

SEQ ID NO: 787111 - DNA, 452 bp, Homo sapiens
  misc_feature: NA.48.35.D02.8.454.heavy.3.multim50
ttgggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagataatggtaa

SEQ ID NO: 787112 - DNA, 494 bp, Homo sapiens
  misc_feature: NA.48.35.D02.10.454.heavy.3.multim50
ttgggtttgggggctttytgrgwktgsrkggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagccgcagtggtctttttgtatgtcctttgtatatggtggggccgaagggacaagtggtcgaccgtctcttcagcctccaccaaggg

SEQ ID NO: 787113 - DNA, 523 bp, Homo sapiens
  misc_feature: NA.52.27.C05.2.454.heavy.3.multim50
agggtttgggggctttctgagagtcatggacctcctgtgcaagaacatgaagcacctgtggttcttcctcctgctggtggcggctcccagatgggtcctgtcccagctgcagctgcaagagtcgggcccacgactggtgaagcctgcggagcccctgtccctcacctgcactgtctctggtgactccatcaccaataatgattactactgggcctggatccgccagcccccagggaaggggctggagtggattggcagtatattttatactggaaatacctaccaaaacccgtccctcaacagccgactcaccatttcagtggacacgtccaagaaccagttctccctgaaactgagctctgtgaccgccgcagacacggccatttattactgtgcgggagagaggcacaagactggagttcccggggagcctggttcggctccgtggggccagggggaccccggtcgaccgtctcctcacggcctccaccaacggcccatcggtctttccccctgggtcccc

SEQ ID NO: 787114 - DNA, 465 bp, Homo sapiens
  misc_feature: NA.52.27.C05.5.454.heavy.3.multim50
agggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcgtggtacagcctggcggggtccctgagactctcctgtgcagcctctggattcagctttgatgagtatgccatgcactgggtccggcaggctccagggaagggcctggagtgggtctcaggtattagttggactagtggtagtataggctatggggcctctgtgaagggccgattcaccatctccagagacaacgccaagaactccctgtctctgcaaatgaacggactgagagttgaggtacacgggcttctactattgtgcaaaaggccctgcccttttctatgat

SEQ ID NO: 787115 - DNA, 371 bp, Homo sapiens
  misc_feature: NA.52.27.C05.6.454.heavy.3.multim50
agggtttgggtccggcagccccccgggaagggcctggagtggattggagatatctactacagcggggggcaccagctacagtccctccctcaagagtcgagttggcatatcaatagacacgtccaagaatcagttctccctgaagctgaaatctatcattgttgcggacacggccgtctattattgtgcgagacatggcagcccatatagtcgctggttcgacccctggggcccgggaatcccggtcaccgtctcccccagcttccaccaagggcccatcggtcttccccctggcgccctgctccaggagcacctctgggggcacagcggccctgggctgcctggtcaaggactacttcctattacgatcg

SEQ ID NO: 787116 - DNA, 521 bp, Homo sapiens
  misc_feature: NA.52.85.H08.1.454.heavy.3.multim50
tcgcgggcacgaccggtgctcgatttagtatcactcagtcgcggggtatcactcagtcgcggggatactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctgatgcctccatcagtcgtgacgattactactggagctggatccgccagcccccagggaagggcctggaatggattggctacatcttttacagtgagagcacctcctacaacccgtccctcaagagtcgagttaccatatcagctgacaagtccaagaaccacttctccctgaagctgacctctgtgactgccacagacacggccgtctattactgtgccagagggatcgctagaggtggctccatcgttttagactccgtggggccagggaaccctggtctccgttct

SEQ ID NO: 787117 - DNA, 472 bp, Homo sapiens
  misc_feature: NA.52.85.H08.2.454.heavy.3.multim50
tcgcggggtctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaagtaacaaatactatgtagactccgtgaagggccgattcaccatctccagagacaattccaagaatacgctgtatctgcacatgaacagcctgagagccgaagacacgggtgtttattactgtgacgaacttaattacggaggacaacggtaacccccgtccaccg

SEQ ID NO: 787118 - DNA, 482 bp, Homo sapiens
  misc_feature: NA.49.58.F03.1.454.heavy.3.multim50
aagggaaagggaaagggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcctagttcagcctggggggtccctgagactctcctgtgcagcctctggattcaccttcagtagctactggatggactgggtccgccaagctccagggaaggggctggtgtgggtctcacgtattaatagtgatgggagtagaaaaagctacgcggactccgtgaagggccgattctccatctccagagacaacgccaagaacacgctgtatctgcaaatgaacagtctgagagccgaggaaacggctgtgtattactgtgcaggtatcgaccgcgacacaaaattcgaagatacagcccagtgactacgtc

SEQ ID NO: 787119 - DNA, 442 bp, Homo sapiens
  misc_feature: NA.40.57.F02.2.454.heavy.3.multim50
ttgggtttgggcacgaccggtgctcgatttagctcgatatagttgggtttgggctcaactctcttgtccgccaggctgcagggaaggggctggaatgggtctctattattagtggtaggacagatagtcgaaactacgctgactccgtgaagggccgcttcaccatctccagagacgtttccaacaacacgatctttctggagatgaatagcctgagagccgaggacacggccaaatattactgtgcgaaaagaaccctctattgtagtggtggaagttgtaactactactttgattcctggggccagggaaccctggtcaccgtctcctcagcctccaccaagggcccatcggtcttccccctggcaccctcctccaagagcacctctgggggcacagcggccctgggctgcctggtcaaggactacttccagtcgctaga

SEQ ID NO: 787120 - DNA, 582 bp, Homo sapiens
  misc_feature: NA.48.23.C01.1.454.heavy.3.multim50
tagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 787121 - DNA, 630 bp, Homo sapiens
  misc_feature: NA.40.57.F02.1.454.heavy.3.multim50
ttgggtttggggtctgagagaggagcccagccctgggactttcaggtgttttcatttggtgatcaggactgaacagagagacctcaccatggactttgggctgaggtggctttttcttgtggctcttttaaaaggtgtccagtgtgaggtgcagttattggagtcggggggaggcttaatacagccgggggggtccctgagactcgcctgtacagcctctggactcacctttagaaatgatgccttgagctgggtccgccaggctgcagggaaggggctggaatgggtctctattattagtggtaggacagatagtcgaaactacgctgactccgtgaagggccgcttcaccatctccagagacgtttccaacaacacgatctttctggagatgaatagcctgagagccgaggacacggccaaatattactgtgcgaaaagaaccctctattgtagtggtggaagttgtaactactactttgattcctggggccagggaaccctggtcaccgtctcctcagcctccaccaagggcccatcggtcttccccctggcaccctcctccaagagcacctctgggggcacagcggccctgggctgcctggtcaaggactacttccagtcgctaga

SEQ ID NO: 787122 - DNA, 459 bp, Homo sapiens
  misc_feature: NA.49.72.G06.2.454.heavy.3.multim50
tctgtgaagccttcacagaccctgtccctcacctgcgctgtctctggtggctccatcaccagtggtggttattcctggacttggatccggcagccaccagggaaggccctggagtggattgggcacatctatcatagtgggaccacctactacaacccgtccctccagagtcgagtcaccatatcagtcgacatgtccgagaaccagttctccctgtacctccactctgtgaccgccgcggacacggccgtctattactgtgccagaggggaactctacttcggggagttaggaatcgctcctgcatttgacatctggggccagggaaacctgggtcaccgtctcctcagcctccaccaagggcccatcggtcttccccctggcaccctcctccaagagcacctctgggggcacagcggccctgggctgcctggtcaaggactacttcctctctcgact

SEQ ID NO: 787123 - DNA, 454 bp, Homo sapiens
  misc_feature: NA.49.72.G06.4.454.heavy.3.multim50
ctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcasttatatcctatgatggaagcaataagcactacgcagagtccgtgaagggccgattgaccatctccagagacaactcgaagaatacggttcttctacaaatgaacagcctgagagctgaggacacggctatsttttactgttgcgagagggaactcgattacagcagcctacg

SEQ ID NO: 787124 - DNA, 477 bp, Homo sapiens
  misc_feature: NA.13.23.C01.1.454.heavy.3.multim50
tagggattgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaattctatgcagactccgtgaagggccgattcaccgtctccagggacaactccaagaacaccttatatctgcagatgaacagcctgagaggtgacgactcggctgtatacttctgtgcgacaaacatgatgtttggagtggatgtgtacttctaccactacggaatggacgtctggggccaagggaccgcggtcaccgtctcctcagcctccaccaagggcccatcggtcttccccctggcaccctcctccaagagcacctctgggggcacagcggccctgggctgcctggtcaaggactacttcctagtacgtgacyg

SEQ ID NO: 787125 - DNA, 412 bp, Homo sapiens
  misc_feature: NA.51.37.D04.1.454.heavy.3.multim50
ttgggtttggggttgggtttggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttcctcgtagcact

SEQ ID NO: 787126 - DNA, 453 bp, Homo sapiens
  misc_feature: NA.51.37.D04.3.454.heavy.3.multim50
ttgggtttggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgtacgtaacttaatcac

SEQ ID NO: 787127 - DNA, 613 bp, Homo sapiens
  misc_feature: NA.51.37.D04.4.454.heavy.3.multim50
ttgggtttgggggctctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggcttcttttttactgtgcgccaggaagcagtggctsgccacatcatgcttttgatatctggagccaagggacaatggtcatcgtctcttcggcctccaccaagggcccatcggtcttcccctggcaccctcctccaagagcacctctgggggcacagcggccctgggctgcctggtcaaggactacttcctcg

SEQ ID NO: 787128 - DNA, 459 bp, Homo sapiens
  misc_feature: NA.51.37.D04.7.454.heavy.3.multim50
ttgggtttggggacccaaaaaccacacccctccttgggagaatcccctagatcacagctcctcaccatggactggacctggagcatccttttcttggtggcagcagcaacaggtgcccactcccaggttcagctggtacagtctggagctgaagtgaagaagcctggggcctcagtgaaggtctcctgcaaggcctctggttacacctttatgaattatggtatcagctgggtgcgccaggcccctggacaagggcttgagtggatgggatggatcagcgcttacactggtgacacaaagtatgcacagaaactccagggcagagtcaccatgaccacagacacgtccacgagcacacgcctacactggaactgaggagccgtgggatctgacgacacggccgtgtattactgtgcgagagataggcccaggggagagtaggtggttttcaccggtcgt

SEQ ID NO: 787129 - DNA, 475 bp, Homo sapiens
  misc_feature: NA.13.67.G01.1.454.heavy.3.multim50
ggggggttgggtttggggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagataccaaccccttacgtactttttggta

SEQ ID NO: 787130 - DNA, 457 bp, Homo sapiens
  misc_feature: NA.13.67.G01.2.454.heavy.3.multim50
ttgggtctgggggaggcttggtacagcctggaaggtccctgagactctcctgtgcagcctctggattcacctttagcagctatgccatgacctgggtccgccaggctccagggaaggggctggcgtgggtctcaggtattagtggtagtggtggaagcacatactacgcagactccgtgaagggccggttcaccatctccagagacaattccaagaacacgctgtatctgcaaatgaacagcctgagagccgaggacacggccgtatattactgtgcagcagtggctggcacaggagcatattactttgactactggggccagggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 787131 - DNA, 473 bp, Homo sapiens
  misc_feature: NA.13.67.G01.3.454.heavy.3.multim50
ttgggtttgggggggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtctgggggaggtgtggtacggcctggggggtccctcagactctcctgtgcaacctctggattcagatttgatgagtatggcatacactgggtccgccaacctccagggaaggggctgcagtgggtctctggtataaactggaatggtgccagcacaacttatgcagactctgtgaagggccgattcaccatctccagagacagtgccgagaactccgtacatctgcaaatgaacagtctcggagtcgaggacacggccttgtatttctgtgcgaggttagcagtggctggtacttacgcaatggacgtcgtc

SEQ ID NO: 787132 - DNA, 485 bp, Homo sapiens
  misc_feature: NA.49.53.E09.4.454.heavy.3.multim50
ttgggtttggggctctgggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagtacttttatgacagtaagtggttttctccgagtatgcactacgg

SEQ ID NO: 787133 - DNA, 464 bp, Homo sapiens
  misc_feature: NA.13.67.G01.5.454.heavy.3.multim50
ttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagttggaagtgagaaatactatgtggactctgtgaagggccgattcaccatctccagagacaacgccaagaactcactgtatctgcaaatgaacagcctgagagccgaggacacggctgtctattactgtgcgagagattggggcggaaggtatagca

SEQ ID NO: 787134 - DNA, 600 bp, Homo sapiens
  misc_feature: NA.49.23.C01.2.454.heavy.3.multim50
tagggattgggggcatcacataacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccagggtaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 787135 - DNA, 460 bp, Homo sapiens
  misc_feature: NA.49.23.C01.4.454.heavy.3.multim50
tagggattggggatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaagggccttgagtgggtgggaaggatcacccctatccttaatatagcaaactatgcacagacattccacgacagagtcacccttatcgcggacaaatccacgaacacagcctacatggaactgcgcagcctaggatctgccgacacgggccgtatatttctgtgcgagagagatgtctttctatgatagtactagtcattatgctt

SEQ ID NO: 787136 - DNA, 489 bp, Homo sapiens
  misc_feature: NA.13.65.F10.1.454.heavy.3.multim50
aggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggtttttggggcgcggactcctcttgagatcgtggggccgagggggacaagtggtcaccgtctcttcagtcccg

SEQ ID NO: 787137 - DNA, 536 bp, Homo sapiens
  misc_feature: NA.49.53.E09.1.454.heavy.3.multim50
ttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccaggggaaccccggtcaccgtctcctctgcctccacsagggacccagtcgtctcccctggcacctcctccaacgagcgactctgggggc

SEQ ID NO: 787138 - DNA, 472 bp, Homo sapiens
  misc_feature: NA.49.53.E09.2.454.heavy.3.multim50
ttgggtttgggggaggcgtggtccagcctgggaggtccctgagactctcctgtgtwgkstytggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 787139 - DNA, 449 bp, Homo sapiens
  misc_feature: NA.49.53.E09.7.454.heavy.3.multim50
ttgggtttggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtsgcgtaacttaatcac

SEQ ID NO: 787140 - DNA, 580 bp, Homo sapiens
  misc_feature: NA.49.53.E09.8.454.heavy.3.multim50
ttgggtttggggagctctgggagaggagcccagcactgggattccgaggtgtttccattcagtgatctgcactgaacacagaggactcgccatggagtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactgggscsasgggaacccctggtcaccgtctcctcagcctccaccaaggggcccatcggtcttccccctggcgccctgctccaggagcacctccgagagcacagcc

SEQ ID NO: 787141 - DNA, 342 bp, Homo sapiens
  misc_feature: NA.49.53.E09.9.454.heavy.3.multim50
ttgggtttggggtgggtctctcttattaattgggatggtggtatcacctactatgcagactctgtgaagggtcgattcaccatctccagagacaacagcagaaactccctgtatctgcaaatgaacagtctcagaggtgaggacaccgccttcgtactactgtgcaaaagattacggtgaccacacctattttgaccactgcggccagggaaccctagtcaccgtctcctcagcctccaccaagggcccatcggtcttccccctggcaccctcctccaagagcacctctgggggcacagcggccctgggctgcctggtcaaggactacttcctctctcgact

SEQ ID NO: 787142 - DNA, 528 bp, Homo sapiens
  misc_feature: NA.48.73.G07.1.454.heavy.3.multim50
agggcacgaccggtgctcgatttagtgacatctcgcagttcttagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaaagggacaagtggtcaccgtcttccgcctccaccaacgggccctacg

SEQ ID NO: 787143 - DNA, 597 bp, Homo sapiens
  misc_feature: NA.53.78.H01.1.454.heavy.3.multim50
agagcatcacataacaaccagattcctcctctaaagaagcccctgggagcacagctcatcaccatggactggacctggaggttcctctttgtggtggcagcagttacaggtctcaactcccaggtccagttggtgcagtctggggctgagttgaagaagcctgggtcctcggtgaaggtctcctgcaagtattctggaggcaccttcaacaactatggtatcagctgggtgcgacaggcccctggacaagggcttgagtggatgggaagggtcacccctatttttgatgaagcagactctgcacagaagttccagggcagattaacgattacggcggacaagtccacgactaccgcctacatggagctgaccagtctgaaatctgaggacacggccctttattactgtgcgagatataccgtgggggttacggcggagatatcgccatactacttcgactactggggccagggaaccctgatcaccgtctcctcagcctccaccaagggcccatcggtcttccccctggccaccctcctccaagagcacctctgggggcacagcggccctgggctgcctggtcaaggactacttccg

SEQ ID NO: 787144 - DNA, 530 bp, Homo sapiens
  misc_feature: NA.53.78.H01.2.454.heavy.3.multim50
ctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaagggcccatcggtcttcccctggccgccctgctccaggagcacctctgggggcacagcggccctgggctgcctggtcaaggactacttcctcgtactgcgtcg

SEQ ID NO: 787145 - DNA, 523 bp, Homo sapiens
  misc_feature: NA.49.9.A09.1.454.heavy.3.multim50
agggcacgaccggtgctcgatttagcgtcgatcaaagggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccagggaaggggctgatgtgggtctcacgtattgatgttgatgggagttacagtgaccacgcggactctgtgaagggccgattcaccgtctccagagaaaacgccaagaacacggtgtatctgcaaatgactggcctgagagccgaggacacggcagtttattactgtgcaagaggcttgtggtcgactgtcgacctggactggtacttcgatctggtggggccgtggccacccgtcgt

SEQ ID NO: 787146 - DNA, 513 bp, Homo sapiens
  misc_feature: NA.49.9.A09.2.454.heavy.3.multim50
agggcacgaccggtgctcgatttagcagacgtctgaacacacaaaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtgacttttatttcatatgatggaagtaataaatactatgcagactccgtgaagggccgattcaccatctccagagacaattccaagaacacgctgtatctgcaaatgaacagcctgagacctgaggacacggctgtttatttctggtgcgaacttaatcacggaggacaacggtccgtacccccgg

SEQ ID NO: 787147 - DNA, 479 bp, Homo sapiens
  misc_feature: NA.52.35.D02.1.454.heavy.3.multim50
ttgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcaccatcaccagggacacatccgcgagcacagcctacatggagttgagcagcctgagaaatgaagacacggctgtatattactgtgcgagaggggaaatggcgtcaagsaattttsgagtmaktattatcctggcggcgcgsctccaacggtcgtc

SEQ ID NO: 787148 - DNA, 494 bp, Homo sapiens
  misc_feature: NA.52.35.D02.2.454.heavy.3.multim50
ttgggtttggggacataacaaccagattcctcctctaaagaagcccctgggagcacagctcatcaccatggactggacctggaggttcctctttgtggtggctgcagttacagctgtccagtcccaggtccacctggtgcagtctggggctgaagtaaagaagcctgggtcgtcggtgaaggtctcctgcagggcctctggagccaccttcggcacttatgggatcagctgggtgcgccaggcccctggacaagggcttgagtggatgggaagggtcatccctttctttgatttaacgaactacgcacagaaattccagggcagagtcaccattaccgcggacgaatccacgaccacagcctacatggagctgcgcaacctaagatctgacgacacggccgtgttttactgtgcgagatttacagtctcgcccacaacttctggtggcggcggtgttccaccttactactttgactcctggggccacggaccct

SEQ ID NO: 787149 - DNA, 612 bp, Homo sapiens
  misc_feature: NA.52.35.D02.3.454.heavy.3.multim50
ttgggtttggggtctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggttgggtytgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttccccctggcaccctcctccaagagcacctctgggggcacagcggccctgggctgcctggtcaaggactacttcctatacgatcg

SEQ ID NO: 787150 - DNA, 490 bp, Homo sapiens
  misc_feature: NA.52.35.D02.4.454.heavy.3.multim50
ttgggtttgggggctctgggagaggagcccagcactgggattccgaggtgtttccattcagtgatctgcactgaacacagaggactcgccatggagtttgggctgagctgggttttccttgttgctattttaaaaggtgtccagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttccccbtggccaccctcctccaagagcacctctc

SEQ ID NO: 787151 - DNA, 593 bp, Homo sapiens
  misc_feature: NA.52.35.D02.6.454.heavy.3.multim50
ttgggtttggggtctctgagagaggaggccagccctgggattttcaggtgttttcatttggtgatcaggactgaacagagagaactcaccattgggtttgggctgagcgtggctctttacgttgtggctattttaaaaggtgtccagtgtgacgtacagctggtggagtcggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgcgaaagatcgaggtcgcatgacagtttttggagtggccaaagacggcaggttccgctacgggttggacgtctggggccaagggaccacggtcaccgtcgcctcagcctccaccaagggcccatcggtcttcccctyggcaccctcctccaagag

SEQ ID NO: 787152 - DNA, 564 bp, Homo sapiens
  misc_feature: NA.52.35.D02.9.454.heavy.3.multim50
ttgggtttgggggagacgagcccagcactggaagtcgccggtgtttccattcggtgatcatcactgaacacagaggactcaccatkgrgtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtggggtggcasttatatcctatgatggaagcaataagcactacgcagagtccgtgaagggccgattggaccatctccagagacaactcgaagaatacggttcttctacaaatgaacagcctgagagctgaggacacggctatcktttactgtgcgagagggaactcgattacagcagccctgaagaacatcatgatggctttgatagtctggggccaaggggacaaagtggtcattgtcttcgttctagcctccaccgtaacgggcccatccggtcctttcccccg

SEQ ID NO: 787153 - DNA, 369 bp, Homo sapiens; identical to SEQ ID NO: 786971
  misc_feature: NA.52.35.D02.10.454.heavy.3.multim50

SEQ ID NO: 787154 - DNA, 472 bp, Homo sapiens
  misc_feature: NA.51.23.C01.1.454.heavy.3.multim50
tagggattgggggcatcacataacaaccagattcctcctctaaagaagcccctgggagcacagctcatcaccatggactggacctggaggttcctctttgtggtggcagcagttacaggtgtccattcccaggtccagctggtgcagtctggggctgaggtgaagatgcctgggtcctcggtgaaggtctcctgcaagtattctggaggcaccttcagcaactatggtatcagctgggtgcgacaggcccctggacaagggcttgagtggatgggaagggtcacccctatatttgatgtagcagactctgcacagaagttccagggcagaataacaattacggcggacaaatccacgaccacagcctacatggagctgagcagcctgagatctgaggacacggccctttattactgtgcgagatttaccgtgggggtcacggcggatatatcgccattacttactttgtacg

SEQ ID NO: 787155 - DNA, 459 bp, Homo sapiens
  misc_feature: NA.51.23.C01.2.454.heavy.3.multim50
tagggattgggggagactgagtgtgagtgaacatgagtgagaaaaactggatttgtgtggcagtttctgaaaacggtgtccttctgtttgcaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaacttgaagaatacggttcttctacaaatgaacagcctgagagctgaggacacggctatgttttactgtgcgagagggaactcgattacagcagccctcgaagaacatcatgatggctttgatatcgtggggaccg

SEQ ID NO: 787156 - DNA, 465 bp, Homo sapiens
  misc_feature: NA.51.23.C01.3.454.heavy.3.multim50
tagggattggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctacgg

SEQ ID NO: 787157 - DNA, 454 bp, Homo sapiens
  misc_feature: NA.51.26.C04.2.454.heavy.3.multim50
tctgggagacgagcccagcactggaagtcgccggtgtttccattcggtgatcatcaccgaacacagaggactcaccatggagtttggactgagctgggttttcctcgttgctcttttaagaggtgtccagtgtcaggtgcagctggtggactctgggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaattatgcagactccgtgaagggccgattcaccatctccagagacaattccaagaacactctatatttgcagatgaatagcctgagaattgaggacgacggctgtgtagttactgtgtggacgagggtcggcatatttccggttttta

SEQ ID NO: 787158 - DNA, 623 bp, Homo sapiens
  misc_feature: NA.48.29.C07.2.454.heavy.3.multim50
agggggggagaggagctccagccttgggactcccagctgtctccactcggtgatcggcactgaatacaggagactcaccatggagtttgggctgagctgggttttccttgttgctattttaaaaggtgtccagtgtgaggtgcagttggtgcagtccgagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 787159 - DNA, 349 bp, Homo sapiens
  misc_feature: NA.48.29.C07.4.454.heavy.3.multim50
agggaaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 787160 - DNA, 452 bp, Homo sapiens
  misc_feature: NA.48.29.C07.5.454.heavy.3.multim50
agggaaaggggagcatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaagcctggggcctcagtgaagatttcctgcaaggcatctggatacatcttcaccacctacaatatacactgggtgcgacaggcccctcgacaagggcctgagtggatgggggatgatcaaccctaggtatggcagcacaagccacgcagagaagttccagggcagagttatcatgaccagcgacacgtccacgagcacagtctacatgagtctgagcagcctgagatctgaagacacggccgtctattactgtgcgaggagggggggtgggtcccgaagactacccg

SEQ ID NO: 787161 - DNA, 619 bp, Homo sapiens
  misc_feature: NA.48.29.C07.6.454.heavy.3.multim50
agggaaaggggtctgagagaggagccttagccctggattccaaggcctatccacttggtgatcagcactgagcaccgaggattcaccatggaactggggctccgctgggttatccttgttgctattttagaaggtgtccagtgtgaggtgcagctggtggagtcaggggggaggcctggtcaagcctggggggtccctgagactctcctgtgcagcctctggattcaccttcagtacctataccatgaactgggtccgccaggctccaggrargggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctactgttcsactttgactactggggccagggaaccctggtcaccgtctcctcagcctccaccaagggcccatcggtcttccccctggcaccctcctccaagagcacctctggggcacagcggccctgggctgcctggtcaaggactacttcctatgtatact

SEQ ID NO: 787162 - DNA, 491 bp, Homo sapiens
  misc_feature: NA.12.33.C11.2.454.heavy.3.multim50
ttgggtttggttgggtttgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtacggccgggggggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtcgtc

SEQ ID NO: 787163 - DNA, 591 bp, Homo sapiens
  misc_feature: NA.49.37.D04.1.454.heavy.3.multim50
ttgggtttgggggctctgggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagtacttttatgacagtagtggtttctccgagtatgcactacggcatggacgtctggggccaagggaccccggtcaccgtctccttagcctccaccaagggcccatcggtccttccccgtggccaccctcccttccaagacgcacctcctc

SEQ ID NO: 787164 - DNA, 578 bp, Homo sapiens
  misc_feature: NA.49.37.D04.2.454.heavy.3.multim50
ttgggtttgggggggagaggagcccagcactgggattccgaggtgtttccattcagtgatctgcactgaacacagaggactcgccattgggtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaagggcccatcggtcctccccctggccgccctcgcctccacggagccacctccgagacgcacagccc

SEQ ID NO: 787165 - DNA, 544 bp, Homo sapiens
  misc_feature: NA.49.37.D04.3.454.heavy.3.multim50
ttgggtttgggtagttgggtttggggggaagaggaagactgacggtcctcccaggagttcaggtgctgggcaccktgggywtgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttcccctggcgccctgctccaggagcacctctgggggcacagcggccstcgggctgcctggtcaaggactacttcctctctcgtacc

SEQ ID NO: 787166 - DNA, 609 bp, Homo sapiens
  misc_feature: NA.49.37.D04.6.454.heavy.3.multim50
ttgggtttggggtgggaaaggagccccagccctgagattcccaggtgtttccattcggtgatcagcactgaacacagaactcaccatggagtttgggctgagctgggttttccttgttgctattttaaaaggtgtccagtgtgaagtgcagttggttgggtttggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttgaccactgcggccagggaaccctagtcaccgtctcctcagcctccaccaagggcccatcggtcttccccctcggcaccctcctccaagagcacctctgggggcacagcggccctgggctgcctggtcaaggactacttcctctctcgact

SEQ ID NO: 787167 - DNA, 560 bp, Homo sapiens
  misc_feature: NA.49.37.D04.9.454.heavy.3.multim50
ttgggtttggggctgggagacgagcccagcactggaagtcgccggtgtttccattcggtgatcatcactgaacacagaggactcaccatkgrgtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaaggcccatcggtcctttccccctcggtccgcccg

SEQ ID NO: 787168 - DNA, 489 bp, Homo sapiens
  misc_feature: NA.51.73.G07.1.454.heavy.3.multim50
agggcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaacggcccacg

SEQ ID NO: 787169 - DNA, 591 bp, Homo sapiens
  misc_feature: NA.16.87.H10.1.454.heavy.3.multim50
tttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatgggttggggggagttggggttttttttcgttacgttacgggtgttcgtcgtggggccgaggggaccgcggtcaccgtctcctcagcctccaccaaggcccatcggtcttccccctggcaccctcctccaagagcacctcg

SEQ ID NO: 787170 - DNA, 405 bp, Homo sapiens
  misc_feature: NA.51.73.G07.3.454.heavy.3.multim50
agggcacgaccggtgctcgatttagtcgctgcgtaaaggagaaaggggctggaatgggtggcagttatttmgkscactggaamcrgtrmwcgatttagtckgatcgmkmmgkgaaagggcccattcgccatctccagagacaattccaaaaataccctctatctgcgaatgaacagcctgcgacctgaagacacggctatatatttctgtgcgagaggggagtcttattgtaatgatggttcctgctatcgttttgacttctggggccagggaaccctggtcaccgtctcctcagcctccaccaagggcccatcggtcttccccctggcaccctcctccaagagcacctctgggggcacagcggccctgggctgcctggtcaaggactacttccctcgtagcact

SEQ ID NO: 787171 - DNA, 477 bp, Homo sapiens
  misc_feature: NA.16.87.H10.2.454.heavy.3.multim50
ttgggtttgggggccccagccctgggattcccagctgtttctgcttgctgatcaggactgcacacagagaactcaccatggagtttgggctgatctgggtcttccttgttgcttttttaaaaggtgtccagtgtgaggwgcagctgktggagtcygggggaggcttrgywcagcctgggrrgtccctgagactctcctgtgcagcctctggattcayctttrrcagctatgycatgacctgggtccgccaggctccagggaaggggctggartgggtctcagktattrstggtrgtggttataccacatactacgcagactccgtgaagggccggttcaccatctccagagacaattccaagaacacactrtatctgcaaatgaacagcctgagagccgasgacacggcccrtatattactgtgcgaaagsaccagggyatrkyagtsrcysrtacywackttgactactggggacc

SEQ ID NO: 787172 - DNA, 428 bp, Homo sapiens
  misc_feature: NA.51.77.G11.2.454.heavy.3.multim50
aagggaaagggcacgaccggtgctcgatttagctagtcactcaagggaaagggaaggggaaagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcatcgtctcctcagcctccaccaagggcccatcggtcttccccctggcaccctcctccaagagcacctctgggggcacagcggccctgggctgcctggtcaaggactacttcctcgtagcact

SEQ ID NO: 787173 - DNA, 374 bp, Homo sapiens
  misc_feature: NA.51.77.G11.3.454.heavy.3.multim50
aagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 787174 - DNA, 627 bp, Homo sapiens
  misc_feature: NA.51.77.G11.1.454.heavy.3.multim50
aagggaaagggggggagaggagcccagcactagaagtcggcggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatttcatatgatggaagtaaaatattctatgtagactccgtgaagggccgcttcatcatctccagagacaattcccagaacaccctgtttctgcaaatgcacagcctgagacctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctcgtagcact

SEQ ID NO: 787175 - DNA, 500 bp, Homo sapiens
  misc_feature: NA.52.55.E11.1.454.heavy.3.multim50
ttgggtttggggaacaaccagattcctcctctaaagaagcccctgggagcacagctcatcaccatggactggacctggaggttcctctttgtggtggctgcagttacagctgtccagtcccaggtccacctggtgcagtctggggctgaagtaaagaagcctgggtcgtcggtgaaggtctcctgcagggcctctggagccaccttcggcacttatgggatcagctgggtgcgccaggcccctggacaagggcttgagtggatgggaagggtcatccctttctttgatttaacgaactacgcacagaaattccagggcagagtcaccattaccgcggacgaatccacgaccacagcctacatggagctgcgcaacctaagatctgacgacacggccgtgttttactgtgcgagatttacagtctcgcccacaacttctggtggcggcggtgttccaccttactacttttgactcctggggccaggggaacccttggtccg

SEQ ID NO: 787176 - DNA, 468 bp, Homo sapiens
  misc_feature: NA.52.55.E11.3.454.heavy.3.multim50
ttgggtttgggacccaacgaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcaccatcaccagggacacatccgcgagcacagcctacatggagttgagcagcctgagaaatgaagacacggctgtatattactgtgcgagaggggaaatggggtaaggtatttttgggagttaattattatccgtggcggtgcgg

SEQ ID NO: 787177 - DNA, 620 bp, Homo sapiens
  misc_feature: NA.52.55.E11.4.454.heavy.3.multim50
ttgggtttggggtgagagaggagcccagccctgggattttcaggtgttttcatttggtgatcaggactgaacagagagaactcaccatggagtttgggctgagctggctttttcttgtggctattttaaaaggtgtccagtgtgaggtgcaactgttggagtytgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctggtcaaggactacttcctatacgatcg

SEQ ID NO: 787178 - DNA, 492 bp, Homo sapiens
  misc_feature: NA.18.59.F04.3.454.heavy.3.multim50
tagggattggggtctgggagaggagccccagccttgggattcccaagtgttttcattcagtgatcaggactgaacacagaggactcaccatggagttttggctgagctggrttttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgtcgagcggacccgggggctccctcaatggtctttcgattacctggggccacaggggtaaa

SEQ ID NO: 787179 - DNA, 530 bp, Homo sapiens
  misc_feature: NA.49.55.E11.2.454.heavy.3.multim50
ttgggtttggggggaagaggaagactgacggtcctcccaggagttcaggtgctgggcaccgttgggtttgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgaccccttggggcccagggagccctggtcaccgtctcctcagcttccaccaagggcccatcggtcttccccctggccgccctgctccaggagcacctctggggcacagcggccctgggctgcctggtcaggactacttcctctctcgta

SEQ ID NO: 787180 - DNA, 481 bp, Homo sapiens
  misc_feature: NA.49.55.E11.3.454.heavy.3.multim50
ttgggtttggggacccaacaaccacatccctcctcagaagcccccagagcacaacgcctcaccatggactggacctggaggatcctctttttggtggcagcagccacaggtgcccactcccaggtccagcttgtgcagtccrgggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagyggcctgagatttgaagacacggctgtgtattactgtgcgagagcaacggtcgtcatgggatttgacttactgggggccaggggaaccccggtcaccgtctcctctgcct

SEQ ID NO: 787181 - DNA, 469 bp, Homo sapiens
  misc_feature: NA.49.55.E11.5.454.heavy.3.multim50
ttgggtttggggagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaaggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttcggaa

SEQ ID NO: 787182 - DNA, 477 bp, Homo sapiens
  misc_feature: NA.40.38.D05.1.454.heavy.3.multim50
tttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggaatctgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatacg

SEQ ID NO: 787183 - DNA, 473 bp, Homo sapiens
  misc_feature: NA.40.38.D05.4.454.heavy.3.multim50
ttgggtttggggatgctttctgagagtcagggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattggggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgasgscccgagcgcagtggtcttttgtatgtcctttgwmtatgtcgggkccgaagggacaagtggtmstaccg

SEQ ID NO: 787184 - DNA, 520 bp, Homo sapiens
  misc_feature: NA.48.12.B01.1.454.heavy.3.multim50
tccgcgggcacgaccggtgctcgatttagtagtgtagatccgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagttatcatctactactttgtatacgttsgggcccc

SEQ ID NO: 787185 - DNA, 492 bp, Homo sapiens
  misc_feature: NA.48.12.B01.3.454.heavy.3.multim50
tccgcgggcacgaccggtgctcgatttagatcgtctrtagwykkgggtktggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatccggtcttccccctcggcgccctgcctccacggagcacctcccgagagcacagcggccctgggctgcctggtcaggacttacc

SEQ ID NO: 787186 - DNA, 433 bp, Homo sapiens
  misc_feature: NA.48.12.B01.4.454.heavy.3.multim50
tccgcgggcacgaccggtgctcgatttagtagtgtagattccgcgggcacgaccggtgctcgatttagtasstctatcagggaaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 787187 - DNA, 628 bp, Homo sapiens
  misc_feature: NA.49.29.C07.1.454.heavy.3.multim50
agggaaagggggctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgaacaggctgagagctgaagacacggctttatattactgtgcgaacttaatcacggagacgaacsgtgaccccgtccgctcggtgcggaggtctggggccaagggaccacggtcatcgtctcctcagcctccaccaagggcccatcggtcttcccctggcaccctcctccaagagcacctctggggcacagcggccctgggctgcctggtcaaggactacttcctctctcgact

SEQ ID NO: 787188 - DNA, 465 bp, Homo sapiens
  misc_feature: NA.16.34.D01.1.454.heavy.3.multim50
ttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggccctgggctgcctggtcaaggactacttccgagtagtaca

SEQ ID NO: 787189 - DNA, 500 bp, Homo sapiens
  misc_feature: NA.49.29.C07.6.454.heavy.3.multim50
agggaaaggggaarskskgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaagccgggggggtccctgagactctcctgtgcagcctctggattcaccttccgttcctataccatgaactggatccgccaggctccgagggaggcgactggagtgggtctcatctattagtggtagaggtgattactacaactacgcagactcactggagggccgattcaccatctccagagacaacaccaagaatttactgtatctgcaaatggacagcctgagagccgacgacacggctgtctattactgtgcgagaggttcgggattattgccgtagtcccgagatcgtccccgacctaacgtcggttacccg

SEQ ID NO: 787190 - DNA, 626 bp, Homo sapiens
  misc_feature: NA.49.29.C07.8.454.heavy.3.multim50
agggaaaggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggrggggggcgtggtccaggctgggaggtccctgagactctcctgtgcagcctctggattcaccttcagtacccatgaaatgcactgggtccgccaggctccaggcaaggggctggagtgggtggcasttatatcctatgatggaagcaataagcactacgcagagtccgtgaagggccgattgaccatctccagagacaactcgaagaatacggttcttctacaaatgaacagcctgagagctgaggacacggctatsttttactgtgcgagagggaactcgattacagcagccctcgaagaacagtcatgatggctttgatatctggggccaagggacaatggtcattgtctcttcagcctccaccaagggcccatcggtcttcccctggcaccctcctccaagagcacctctgggggcacagcggcctgggctgcctgtcaaggactactctctctcg

SEQ ID NO: 787191 - DNA, 618 bp, Homo sapiens
  misc_feature: NA.48.25.C03.2.454.heavy.3.multim50
ctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggarwcrgggagaggtgatggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctgcgccctgctccaggagcacctccgagagcacagcggccctgggctgcctggtcaaggactacttcctatgtatactcg

SEQ ID NO: 787192 - DNA, 438 bp, Homo sapiens
  misc_feature: NA.48.25.C03.4.454.heavy.3.multim50
catcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggttggataaagccacgagcacagtctacatgcagctgagcagcctgagacacaacgacacggccgtctattattgttccagagataatcgcgtgaataaagatatggaa

SEQ ID NO: 787193 - DNA, 453 bp, Homo sapiens
  misc_feature: NA.48.25.C03.5.454.heavy.3.multim50
ctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagaggacgaggacacggctgtttattactgtgcgagagtgcgggatttcacctacacaggg

SEQ ID NO: 787194 - DNA, 467 bp, Homo sapiens
  misc_feature: NA.48.25.C03.7.454.heavy.3.multim50
ctctgggagtggagccccagccttgggattcccaagtatttgtattcagtgatcaggactgaacacacaggactcaccatggagttggggctgagctgggttttccttgttgccatattagaaggtgtccactgtgaggtgcagctggcggagtctggggggagacttggtacagcctgggggagtccctgagactctcctgtgcagcctctggattcaccttcagtttgtttgacatgcactgggtccgccaggctccaggaaaaggtctggagtgggtctcagtcatgggtacagctggtcacacatactatgcagacctccgtaaagggccgattcaccatctcctagagaagacgccaagaattccttgtatcttcagatgaacagtctgagaaccgatgacacggctggtgtattattgtgacgaaaaggggggtagacgagctcggtccactcctacttcg

SEQ ID NO: 787195 - DNA, 485 bp, Homo sapiens
  misc_feature: NA.52.38.D05.1.454.heavy.3.multim50
ttgggtttggggtctgagagaggaggccagccctgggattttcaggtgttttcatttggtgatcaggactgaacagagagaactcaccatggagtttgggctgagctggctctttcttgtggctattttaaaaggtgtccagtgtgacgtacagctggtggagtcggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgcgaaagatcgaggtcgcatgacagtttttggagtggccaaagacggcgtac

SEQ ID NO: 787196 - DNA, 443 bp, Homo sapiens
  misc_feature: NA.52.38.D05.5.454.heavy.3.multim50
ttgggtttggggtctgggagaggagcccagcactagaagtcggcggtgtttccattcggtgatcagcactgaccacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcaatagctatggcatgcactgggtccgccaggctccaggcaaggggctgaggtgggtggccagtatgtcatatggtggacttaatgcatactatgcagactccgtgaagggccgattcatcatctccagagacaattccaagaacacgctgtatctgcaaatgaacagcctgagagctgaggacacggctgtgtattactgtgacgaaagta

SEQ ID NO: 787197 - DNA, 623 bp, Homo sapiens
  misc_feature: NA.52.37.D04.1.454.heavy.3.multim50
ttgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcaactgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttccccctggcaccctcctccaagagcacctctgggggcacagcggccctgggctgcctggtcaaggactacttcctatacgatcg

SEQ ID NO: 787198 - DNA, 642 bp, Homo sapiens
  misc_feature: NA.52.37.D04.3.454.heavy.3.multim50
ttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggttgggtytgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttccccctggcaccctcctccaagagcacctctgggggcacagcggccctgggctgcctggtcaaggactacttcctatacgwacg

SEQ ID NO: 787199 - DNA, 620 bp, Homo sapiens
  misc_feature: NA.52.37.D04.5.454.heavy.3.multim50
ttgggtttggggagacgagcccagcactggaagtcgccggtgtttccattcggtgatcatcactgaacacagaggactcaccattgggtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagtcctccaccaagggcccmatcggtcttcccccggcaccctcctccaagagcacctctgggggcacagcggccctgggctgcctggtcaaggactacttccta

SEQ ID NO: 787200 - DNA, 493 bp, Homo sapiens
  misc_feature: NA.52.37.D04.7.454.heavy.3.multim50
ttgggtttggggtctctgagagaggaggccagccctgggattttcaggtgttttcatttggtgatcaggactgaacagagagaactcaccatggagtttgggctgagctggctctttcttgtggctattttaaaaggtgtccagtgtgacgtacagctggtggagtcggggggagccttccaacgaccccggggggggtccctgagactcacctgtgaagcctctggatttagatttagcagccaatgccatgacctgggtcccgccaggctccgaggtcaggggctggagtgggtctcaggtattagacggaactgggtgataccacgtactacgcggactctgtgaagggccgcttcaccatctctagggacagttccaagwacacgctgtatctgmmaatgaatagcctgagagtcgaggaccacggccgtttattactgtgcgtaaagatcgaggtcgcatgactagttttggagtggcaagacggacg

SEQ ID NO: 787201 - DNA, 369 bp, Homo sapiens; identical to SEQ ID NO: 786971
  misc_feature: NA.52.37.D04.8.454.heavy.3.multim50

SEQ ID NO: 787202 - DNA, 464 bp, Homo sapiens
  misc_feature: NA.53.30.C08.1.454.heavy.3.multim50
aagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggtacacggccacttttattactgtgcaaggaacagcataatgactcgtcccccggactttgtaccg

SEQ ID NO: 787203 - DNA, 510 bp, Homo sapiens
  misc_feature: NA.53.30.C08.2.454.heavy.3.multim50
aagggaaagggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcacttatatcctatgatggaagcaataagcactacgcagagtccgtgaagggccgattgaccatctccagagacaactcgaagaatacggttcttctacaaatgaacagcctgagagctgaggacacggctatcttttactgtgcgagagggaactcgattacagcagccctcgaagaacatcatgatggctttgattatctgggggccaaggggact

SEQ ID NO: 787204 - DNA, 449 bp, Homo sapiens
  misc_feature: NA.53.30.C08.3.454.heavy.3.multim50
aagggaaagggggggagacgagcccagcactggaagtcgccggtgtttccattcggtgatcatcactgaacacagaggactcaccatggagtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctatgcactgggtccgccaggctccaggcaaggggctggagtgggtggcacttatctcatctgatggaagagatgtctattacgcagactccgtgaagggccgattcaccatctccagagacaattccaagaacacactgtatctgcaaatggacagtctgagaactgaagacacggctgtgtattactgtgcgagtgagatgtcttact

SEQ ID NO: 787205 - DNA, 491 bp, Homo sapiens
  misc_feature: NA.52.45.E01.1.454.heavy.3.multim50
cctctgggagaggagcccagcactgggattccggggtgtttccattcagtgatctgcactgaacacagaggactcgccatggagtttgggctgagctgggttttccttgttgctattttaaaaggtgtccattgtgaggtgcagctggtggagtctgggggaggcttggtccagccgggggggtccctgagactctcctgtgcagcctctgaattcagcgtcagtagcgactacatgagctgggtccgccaggctccagggaaggggctgggagtgggtcacagttattccaaccggtgggagcgcacactacgcagattccgtgaagggcaggttcaccatctccagagacaatttgaggaacacggtgcatcttcacatgaacagcctgagagccgaggacacggctgtttattactgtgcgagggtaaattggaactacggcgggggacttccgacccctggggccaggggaaccctggtcaccgtyc

SEQ ID NO: 787206 - DNA, 458 bp, Homo sapiens
  misc_feature: NA.52.45.E01.2.454.heavy.3.multim50
acccaacaaccacatccctcctcagaagcccccagagcacaacgcctcaccatggactggacctggaggatcctctttttggtggcagcagccacaggtgcccactcccaggtccaaattgtgcagtctggggctgaggtgaagaagcctggggcctcagtgaaggtttcctgcaaggcttctggatacagtttcactaggtattcgatgcattggctgcgccaggcccccggacaaaggcctgagtggatgggaagtctcagtgatggcaaaggtgacaaaaagtattcacagaagttccagggcagagtcaccattaccagcgacgcatccgcgaacacagcctatatggaactcagcagcctgagatctgaagacacggctgtctattactgtgcgagggtcggcacgctgacaacctcttacttctattcctacgctatggactctcgggcccg

SEQ ID NO: 787207 - DNA, 368 bp, Homo sapiens; identical to SEQ ID NO: 787014
  misc_feature: NA.49.77.G11.2.454.heavy.3.multim50

SEQ ID NO: 787208 - DNA, 484 bp, Homo sapiens
  misc_feature: NA.49.77.G11.3.454.heavy.3.multim50
aagggaaagggragskskgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaagccgggggggtccctgagactctcctgtgcagcctctggattcaccttccgttcctataccatgaactggatccgccaggctccagggaggcgactggagtgggtctcatctattagtggtagaggtgattactacaactacgcagactcactggagggccgattcaccatctccagagacaacaccaagaatttactgtatctgcaaatggacagcctgagagccgacgacacggctgtctattactgtgcgagagttcgggatattgccgtagtcccagatgtcccgaccaacttc

SEQ ID NO: 787209 - DNA, 332 bp, Homo sapiens
  misc_feature: NA.49.77.G11.4.454.heavy.3.multim50
aagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcrcctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 787210 - DNA, 589 bp, Homo sapiens
  misc_feature: NA.49.77.G11.5.454.heavy.3.multim50
aagggaaaggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagccccmagggaargggcttgagtggattgggagtatatattttactgggacgtcctactacaacccgtccctcaagagtcgagtcaccatatcagaagacacatccaagaaccaattctccttgaagctgacctctgtgaccgccgcggacaccggccgtgtattactgtggagttccagctgtcggatactactactactacggtgtggacgtcgtggggccaagggaccacggtcaccgtctcctcagcctccaccaagggcccatcggtccttccccctggccgccctgctccaggagcacctccgagagcacagcggccctgggctgcctggtcaaggactacttcctctctcgact

SEQ ID NO: 787211 - DNA, 488 bp, Homo sapiens
  misc_feature: NA.51.34.D01.1.454.heavy.3.multim50
ttgggtttggggagctctgagagaggagcccagccctgggattttcaggtgttttcatttggtgatcaggactgaacagagagaactcaccatggagtttgggctgagcgtggckttttcttgtggctattttaaaaggtggccagtgtgaggtgcagctgttagagtctgggggaggcttggtccagcctggggggtccctcagactctcctgtgcagcctcgggaattatatttaagaactttgccatgagttgggtccgccaggctccagggaaggggctggaatgggtctccactattagtggcagcggtgatgacacattctacacagactccgtgaggggccgtttcaccatctccagagacaatgccaaagacacgctctatctggaagtgaagagcctgagagtcgaggacacggccgtcttttattgtgtgaaggggcgtgggacttattcttcaggaccatattactttgtacttcgc

SEQ ID NO: 787212 - DNA, 462 bp, Homo sapiens
  misc_feature: NA.51.34.D01.5.454.heavy.3.multim50
ttgggtttggggacccaaaaaccacacccctccttgggagaatcccctagatcacagctcctcaccatggactggacctggagcatccttttcttggtggcagcagcaacaggtgcccactcccaggttcagctggtacagtctggagctgaagtgaagaagcctggggcctcagtgaaggtctcctgcaaggcctctggttacacctttatgaattatggtatcagctgggtgcgccaggcccctggacaagggcttgagtggatgggatggatcagcgcttacactggtgacacaaagtatgcacagaaactccagggcagagtcaccatgaccacagacacgtccacgagcacagcctacactggaactgaggagcctgggatctgacgacacggccgtgtacttactgtgcgagagataggccccaggggagagtagtggttttcaccgctggcagtt

SEQ ID NO: 787213 - DNA, 394 bp, Homo sapiens
  misc_feature: NA.51.34.D01.6.454.heavy.3.multim50
gttgggtttggggggaagaggaagactgacggtccccccaggagttcaggtgctggactgggtggcaggcatatcatttgatggaagcaagaagtactatgcagactccgtgaagggccgattcaccatctccagagacagttccgatgacacagtctatctacacatgagcagtgtgagacctgacgacacggctcttttttactgttgcgccaggaagcagtggctggccacatcatgcttttgatatctggagccaagggacaatggtcatcgtctcttcggcctccaccaagggcccatcggtcttccccctggcaccctcctccaagagcacctctgggggcacagcggccctgggctgcctggtcaaggactacttcctcgtagcact

SEQ ID NO: 787214 - DNA, 511 bp, Homo sapiens
  misc_feature: NA.51.34.D01.7.454.heavy.3.multim50
ttgggtttggggaggtctgagagaggagcccagccctgggattttcaggtgttttcatttggtgatcaggactgaacagagagaactcaccatggagtttgggctgagctggctttttcttgtggcttttttaaaaggtgtccagtgtgaggtggaacttttggagtctgggggaggcttggtacagcctggggggtccctgagactctcctgtgcagcctcaggtttcacctttgacacctatgccatggcctgggtccgccagtctccaggaaaggggcttgagtgggtctcaagtataagtgacagtggtagaaaatatctattacgcggactccgtgaagggccggttcaccatctccagagacaactccaagagcacactatatttacaaatgaaacagcctgagagccgaggacgacgggcgcatatttctgtgcgaaagaaccggaaaaaatacgttagtcttactcgtgtctttgtactccgtggggccgagggacgcccgtc

SEQ ID NO: 787215 - DNA, 483 bp, Homo sapiens
  misc_feature: NA.48.38.D05.7.454.heavy.3.multim50
ttgggtttggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccacgcccccagggaaggggctggagtggattgggagtatttaccacagtgggagcacctactacaacccgtccctcaaaagtcgaggcaccatatccgtagacacgtccaagaaccaattctccctgaagctgagctctgtcgaccgccgcagacacggctgtctattactgtgcgaggccccggagccgcacggtgkctttttgtattgcctttgattatggttcgggggccraaggggaccaagtggtcaccgtt

SEQ ID NO: 787216 - DNA, 521 bp, Homo sapiens
  misc_feature: NA.48.38.D05.2.454.heavy.3.multim50
ttgggtttgggcacgaccggtgctcgattgggtttggggtctgggagaggagctccagccttgggactcccagctgtctccactcggtgatcggcactgaatacaggagactcaccatggagtttgggctgagctgggttttccttgttgctattttaaaaggtgtccagtgtgaggtgcagttggtgcagtccgggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctagttc

SEQ ID NO: 787217 - DNA, 489 bp, Homo sapiens
  misc_feature: NA.48.38.D05.4.454.heavy.3.multim50
ttgggtttgggggactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgtactacacaccatcttgacgactgggggatgcttttctatttctggggcccaggggaccgtggtcgccgtgtctacagcctccaccaagggcccatcggtcttcccctggcta

SEQ ID NO: 787218 - DNA, 491 bp, Homo sapiens
  misc_feature: NA.48.38.D05.5.454.heavy.3.multim50
ttgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagtttccctgacgctgacgtctgtgaccgccgcagacacggctgtctattattgtgcgagactaggcttctgtagtggtggtacttgcaacccgggatactactccacttcggcttggacatctggggccaagggacctcggtcgtcccg

SEQ ID NO: 787219 - DNA, 491 bp, Homo sapiens
  misc_feature: NA.48.38.D05.6.454.heavy.3.multim50
ttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatcgaccacagacacatccacgagcacagcctacatggagctgaggagcctgagatctgacgacacggccgtgtattactggtgacggagrrgtaagggtttttactagttgggttcgggggacgttccgtacccgaccccaggccaacgtkgktacccgg

SEQ ID NO: 787220 - DNA, 457 bp, Homo sapiens
  misc_feature: NA.52.68.G02.3.454.heavy.3.multim50
acccaacaaccacatccctcctcagaagcccccagagcacaacgcctcaccatggactggacctggaggatcctctttttggtggcagcagccacaggtgcccactcccaggtccaaattgtgcagtctggggctgaggtgaagaagcctggggcctcagtgaaggtttcctgcaaggcttctggatacagtttcactaggtattcgatgcattggctgcgccaggcccccggacaaaggcctgagtggatgggaagtctcagtgatggcaaaggtgacaaaaagtattcacagaagttccaggggcagagtcaccattaccagcgacgcatccgcgaacacagcctatatggaactcagcagcctgagatctgaagacacggctgtctattactgtgcgagggtcggcacgctgacaacctcttacttctacttcctacgctatggaacgttcgtc

SEQ ID NO: 787221 - DNA, 486 bp, Homo sapiens
  misc_feature: NA.52.58.F03.2.454.heavy.3.multim50
aagggaaaggggagctctgggagacgagcccagcactggaagtcgccggtgtttccattcggtgatcatcactgaacacagaggactcaccatggaatttgggctgacttgggttttcctcgttgctcttttaagaggtgtccagtgtcaggtgcaactggtggagtctgggggaggcgtggtccagcctgggaggtccctgagactctcctgtgtcgcctctggattcaccttcagtatttatggcatttattgggtccgtcaggctccaggcaaggggctgkaatgggtggcctttatttcatatgatggaaccaataaagcctacactgactccgtgaagggccgattcaccatctcccgagacaattccaagaacacactctatctgcaaatgaacagcctgagacatgaggacacggctgttttactcttgtgcgagaattgccctcgtttacgggggcccttttgactaacgtcggggcc

SEQ ID NO: 787222 - DNA, 474 bp, Homo sapiens
  misc_feature: NA.52.58.F03.3.454.heavy.3.multim50
aagggaaaggggctgggagacgagcccagcactggaagtcgccggtgtttccattcggtgatcatcactgaacacagaggactcaccatggagtttgggctgagctgggtttttcctcgttgctcttttaagaggtgtccagtgtcaggtacaactggtggagtctgggggaggcgtggtccagcctgggaggtccctgagactctcctgtgcagcctctggattcaccttcagtacctatagtatacactgggtccgccaggctcctggcaagggactggagtgggtggcatctatatcaaatgatggaaacaataaccattctacagactccgtaaagggccgattcaccatctccacgagacaattccaagaacacggtgtctctacaaatagaacagtttgagacttgaggacacggctgtatattactgtgcgcgagggaattcgattatagcagccctacgaacgacc

SEQ ID NO: 787223 - DNA, 615 bp, Homo sapiens
  misc_feature: NA.52.34.D01.2.454.heavy.3.multim50
ttgggtttggggagctctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttccccctggcaccctcctccaagagcacctctgggggcacagcggccctgggctgcctggtcaaggactacttcctatacgatcg

SEQ ID NO: 787224 - DNA, 636 bp, Homo sapiens
  misc_feature: NA.52.34.D01.3.454.heavy.3.multim50
ttgggtttggggctcggagaggagccttagccctggactccaaggcctttccacttggtgatcagcactgagcacagaggactcaccwtggrkttggggctgagctgggttttccttgttgctattttagaaggtgtccagtgtgaggcgcagctggtkgrgtytgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaacgggcccatcggtcttccccctggccaccctcctccaagagcacctctgggggcacagcggccctgggctgcctggtcaaggactacttcctatacg

SEQ ID NO: 787225 - DNA, 585 bp, Homo sapiens
  misc_feature: NA.49.68.G02.2.454.heavy.3.multim50
ctctgggagaggagcccagcactgggattccgaggtgtttccattcagtgatctgcactgaacacagaggactcgccatggaatttgggctgagctgggttttccttgttgctattataaaaggtgtccagtgtgaggtgcaactggtgcagtctgggggagcttggtccagcctgggatttccctgagactctcctgtgcagcctctggagtcaccgtcagcaacaactacatgagctgggtccgccaggctccaggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 787226 - DNA, 460 bp, Homo sapiens
  misc_feature: NA.53.53.E09.3.454.heavy.3.multim50
ttgggtttgggggagcatcaccctgcaaccacagctgtcctctagagaacccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgacatctgacgacacggccgttttattacttgttgtgagaggaggaccccggatcgaccttcc

SEQ ID NO: 787227 - DNA, 462 bp, Homo sapiens
  misc_feature: NA.49.68.G02.4.454.heavy.3.multim50
agccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcctagttcagcctggggggtccctgagactctcctgtgcagcctctggattcaccttcagtagctactggatggactgggtccgccaagctccagggaaggggctggtgtgggtctcacgtattaatagtgatgggagtagaaaaagctacgcggactccgtgaagggccgattctccatctccagagacaacgccaagaacacgctgtatctgcaaatgaacagtctgagagccgaggaaacggctgtgtattactgtgcaggtatcgaccgcgacacaaaattcgagatacacgcccagtgactactc

SEQ ID NO: 787228 - DNA, 516 bp, Homo sapiens
  misc_feature: NA.53.53.E09.1.454.heavy.3.multim50
ttgggtttgggcacgaccggtgctcgatttagatcgtctgtgttgggtttggggctgggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtggtttccatgatgcttttgatgtcgtc

SEQ ID NO: 787229 - DNA, 527 bp, Homo sapiens
  misc_feature: NA.53.53.E09.2.454.heavy.3.multim50
ttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaagggcccatcggtcttccccctcggcgtcccgacgcacctctgggggcagagcggccctgggctgcctgtcaaggactactctcgtact

SEQ ID NO: 787230 - DNA, 463 bp, Homo sapiens
  misc_feature: NA.49.82.H05.3.454.heavy.3.multim50
cacgaccggtgctcgatttagtctgatmgwgaagggaaaggggtctgggagaggagcccagcactgggattccgaggtgtttccattcagtgatctgcactgaacacagaggactcgccatggaatttgggctgagctgggtttttccttgttgctattataaaaggtgtccagtgtgaggtgcaactggtgcagtctgggggaggcttggtccagcctgggatttccctgagactctcctgtgcagcctctggagtcaccgtcagcaacaactacatgagctgggtccgccaggctccaggaaaggggctggagtgggtctcacttatttatagtggcggtaacacaaggtacgcagactccgtgaggggccgattccaccatctccagagacagttccaagaaccaccctgtatcttcaaatgaacagtctgagacctgacgacacggctgtctatttact

SEQ ID NO: 787231 - DNA, 457 bp, Homo sapiens
  misc_feature: NA.18.50.E06.1.454.heavy.3.multim50
cctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgtcgagcgacccggggctcctcaatggctttcattacgs

SEQ ID NO: 787232 - DNA, 471 bp, Homo sapiens
  misc_feature: NA.18.50.E06.2.454.heavy.3.multim50
ctgggagaggagcccagcactgggattccgaggtgtttccattcggtgatcagcactgaacacagaggactcaccatggagttttggctgagctggattttccttgttgctatttcaaaaggtgtccastgtgaggwgcagttggtggagactggaggargcytgatccagcckggggggtccctgagactstcctgtgyagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggcccggggaaccctgggtcaccggtctccccc

SEQ ID NO: 787233 - DNA, 488 bp, Homo sapiens
  misc_feature: NA.18.50.E06.3.454.heavy.3.multim50
ctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctkagactsycctgtryagyctctggrttcasyktcagtcrmgrcckrsatgarytggktccgccgaggctccagggaaggggctggagtgggttggccgtattaaaaccaaaactgatggtgggacaacagactacgctgcacccgtgaaaggcagattcaccatctcaagagatgattacaaaaagcacgctgtatctgacaaatgaacagcctgagaaccgaggacacagccgtgtaattactrygttaccacagtcccctgaaaagcggttaccaaaccttactactaacttacgggttaa

SEQ ID NO: 787234 - DNA, 323 bp, Homo sapiens; identical to SEQ ID NO: 786400
  misc_feature: NA.49.45.E01.4.454.heavy.3.multim50

SEQ ID NO: 787235 - DNA, 477 bp, Homo sapiens
  misc_feature: NA.51.27.C05.1.454.heavy.3.multim50
agggtttggggtctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagtaactatgcaatgcactgggtccgccaggctccaggcaaggggctggactgggtggcaggtatatcatatgatggaagcaataaatactacgcagactccgtgaagggccgattcaccatctccagagacagttccgatgacacagtctatctgcaaatgaacagcctgagagctgaggacacggcttctttttactgtgcgccaggaagcagtggctggccacatcatgctttttggattacg

SEQ ID NO: 787236 - DNA, 374 bp, Homo sapiens
  misc_feature: NA.13.86.H09.2.454.heavy.3.multim50
ttgggtttgggtccgcctgtccccagggaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggcgccctgctccaggagcacctccgagagcacagcggccctgggctgcctggtcaaggactacttcctagtackwgacg

SEQ ID NO: 787237 - DNA, 529 bp, Homo sapiens
  misc_feature: NA.48.15.B04.1.454.heavy.3.multim50
tccgcgggcacgaccggtgctcgatttagacagtatatatccgcgggcacgaccggtgctcgatttagtacacgyrmttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctgggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtgkcttttgtatgtcctttgatatggttcggggaccg

SEQ ID NO: 787238 - DNA, 520 bp, Homo sapiens
  misc_feature: NA.48.15.B04.2.454.heavy.3.multim50
tccgcgggcacgaccggtgctcgatttagacagtatatatccgcgggcacgaccggtgctcgatttagaygckatmgactwgggtttggggggggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcgaaggggctggagtgggtggctgttgtgtcaaatgatggacatgctgaatatgcagacttccgtggacgggggccgagttccgcctttctccagagacaatttccaaagacgcacgggttcatcctagctaaatggagccgccctgagacctgacgacacggctgtctatta

SEQ ID NO: 787239 - DNA, 457 bp, Homo sapiens
  misc_feature: NA.48.15.B04.3.454.heavy.3.multim50
tccgcgggcacgaccggtgctcgatttagatmgctctgygttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacaccaaactatgcacagaagctccagggcagagtcaccatgaccacagaacacatccacgagcacagcctacatggagctgaggagcctgagatctgacgacgacggccgtgtattactgtgcg

SEQ ID NO: 787240 - DNA, 414 bp, Homo sapiens
  misc_feature: NA.48.15.B04.4.454.heavy.3.multim50
tccgcgggcacgaccggtgctcgatttagtgygagywstyycgcgggcacgaccggtgctcgatttagtacacryrmttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaaggggacaatggtcaccgtctcttcagcctccaccaagggcccatcggtcttccccctggcaccctcctccaagagcacctctgggggcacagcggccctgggctgcctggtcaagggactacttcctatgtatact

SEQ ID NO: 787241 - DNA, 585 bp, Homo sapiens
  misc_feature: NA.49.42.D09.1.454.heavy.3.multim50
agggaaaggggatgcttagggaaagtgggggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagcccccagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 787242 - DNA, 465 bp, Homo sapiens
  misc_feature: NA.49.42.D09.3.454.heavy.3.multim50
agggaaagggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcacttatatcctatgatggaagcaataagcactacgcagagtccgtgaagggccgattgaccatctccagagacaactcgaagaatacggttcttctacaaatgaacagcctgagagctgaggacacggctatcttttactgtgcgagaggaawctcgattacagcagcsstmcg

SEQ ID NO: 787243 - DNA, 437 bp, Homo sapiens
  misc_feature: NA.49.28.C06.2.454.heavy.3.multim50
ctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttaatcaac

SEQ ID NO: 787244 - DNA, 613 bp, Homo sapiens
  misc_feature: NA.49.28.C06.6.454.heavy.3.multim50
acggtgttttcgagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttgaccactgcggccagggaaccctagtcaccgtctcctcagcctccaccaagggcccatcggtcttcccctggcaccctcctccaagagcacctctgggggcacagcggccctgggctgcctggtcaaggactacttcctctctcgact

SEQ ID NO: 787245 - DNA, 531 bp, Homo sapiens
  misc_feature: NA.49.28.C06.7.454.heavy.3.multim50
ctgagctgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagasgcacctctgggggcacagcggccctgggctgcctggtcaaggactacttcctctctcgact

SEQ ID NO: 787246 - DNA, 469 bp, Homo sapiens
  misc_feature: NA.13.33.C11.1.454.heavy.3.multim50
ttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaaacgatgcttttgatatgtggggaccgagggactacg

SEQ ID NO: 787247 - DNA, 448 bp, Homo sapiens
  misc_feature: NA.48.57.F02.1.454.heavy.3.multim50
ttgggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagatatac

SEQ ID NO: 787248 - DNA, 556 bp, Homo sapiens
  misc_feature: NA.48.57.F02.2.454.heavy.3.multim50
ttgggtttggcacgaccggtgctcgatttagctcgatatagttgggtttgggagggctttgttgggtttgggggtgactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgtacacacaccatcttgacgactggggatgcttttcatttctggggccaggggaccgtggtcgccgtgtctacagcctccaccaacgggcccatcggtcttccccctcggcctaccct

SEQ ID NO: 787249 - DNA, 664 bp, Homo sapiens
  misc_feature: NA.48.57.F02.4.454.heavy.3.multim50
ttgggtttgggcacgaccggtgctcgatttagatygkstktgkkgrgctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtygggttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 787250 - DNA, 499 bp, Homo sapiens
  misc_feature: NA.48.57.F02.5.454.heavy.3.multim50
ttgggtttggggggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaagggacctcggtcgccgtttcctcagcctccaccaaggrcccg

SEQ ID NO: 787251 - DNA, 470 bp, Homo sapiens
  misc_feature: NA.48.57.F02.7.454.heavy.3.multim50
ttgggtttgggggctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagaccgaggacacggcttgtttattactgttgcgagagtggcggtatttcacctacgacgtac

SEQ ID NO: 787252 - DNA, 495 bp, Homo sapiens
  misc_feature: NA.48.57.F02.8.454.heavy.3.multim50
ttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctaccagggcagagtcaccatgaccacagacacatccacgagcacacgcctacatggagctgaggagcctgagatactggacgacacggccgtgtacttactgtgcggagaggtaagggttttactagttgggttcggggagtwstccgwcccagyacmcwggcytamcgttcgggttacccg

SEQ ID NO: 787253 - DNA, 503 bp, Homo sapiens
  misc_feature: NA.18.33.C11.2.454.heavy.3.multim50
ttgggtttgggggggagaggagcccagcactgggattccgaggtgtttccattcggtgatcagcactgaacacagaggactcaccatggagttttggctgagctggrttttccttgytgctatttyaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacactcccctgaaacgcgtcaactactactactacggtatggacctctggggccaagggacccg

SEQ ID NO: 787254 - DNA, 343 bp, Homo sapiens
  misc_feature: NA.13.42.D09.2.454.heavy.3.multim50
agggaaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactactggggccagggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 787255 - DNA, 614 bp, Homo sapiens
  misc_feature: NA.49.87.H10.5.454.heavy.3.multim50
ttgggtttggggagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttgacctactgcggccagggaaccctagtcaccgtctcctcagcctccaccaagggcccatcggtcttcccctggcaccctcctccaagagcacctctgggggcacagcggccctgggctgcctggtcaaggactacttcctctctcgact

SEQ ID NO: 787256 - DNA, 471 bp, Homo sapiens
  misc_feature: NA.49.87.H10.7.454.heavy.3.multim50
ttgggtttggggatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttccgaacaactttgctgtcagtctgggtgcgacacggcccctggacaaggtccttgagtggggtagggaagggactcacccctatccttaatatagcaaactatgcacagaccattccgaacgacgagagtcacccttatcgcggaacaaactccaacgaacacagcctacatggaactgacgcagcctaggatctgccgacacggccgtatatttctgtgcgagagagatgtctttctatgatagtactagtcattat

SEQ ID NO: 787257 - DNA, 583 bp, Homo sapiens
  misc_feature: NA.49.87.H10.8.454.heavy.3.multim50
ttgggtttgggggggagaggagcccagcactagaagtcggcggtgtttccattcggtgatcagcactgaacacagaggactcaccatkgrgtttgggctgagctgggttttcctcgttgctcttttaagaggtgtccwttgtcaggtgcagttrrtggagtcggggggatctgtggtccggcctgggargtccctgagactctcctgtrcwgcctccggattcaasttcgrraaytatggcttacactgggtccgccaggctccaggcaaggggctggagtgggtggcagtwatttcatatgattcaagtattggatattacgcagagtccgtaaagggccgattcaccatctccagagacaattcgaagaacaccatgtatctggaactgagcagagtcacatctgaggacacggctatgtattactgttgtgaaagacttttatgacagtagtggttttctccgagtatgcacattacggtcatggacgtctggggccaagggacccggtcaccgtctccttagcctccaccaagggcccatcggtcttccccctggccaccctcctccaagagcacctcg

SEQ ID NO: 787258 - DNA, 489 bp, Homo sapiens
  misc_feature: NA.13.62.F07.2.454.heavy.3.multim50
aagggaaagggtctgtgcaggcttcagcagtcctggacctcccgtgcaagaacatgaaacacctgtggttcttcctcctgctggtgtcagctcccagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccagggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaggcaaacgtccgaagtcgttatcactttgactcctggggccagggaaccctggtcg

SEQ ID NO: 787259 - DNA, 409 bp, Homo sapiens
  misc_feature: NA.52.5.A05.2.454.heavy.3.multim50
aggggttgggggcaatttataaacccaaaaggacatggccatgcagcgggtagggacaatacagacagatatcagcctgaaatgtagcctcagggcacaggtgggcacgggcactgtccacctaagccaggggcagacccgagtgtccccgcagtagacctgagagcgctgggcccacagcctcccctcggtgccctgctacctcctcaggtcagccctgggcatcccgggtttccccagtcctggcgtgctacgatctggacgtctggggccaagggaccacggtcaccgtctcctcagcctccaccaagggcccatcggtcttccccctggcaccctcctccaagagcacctctgggggcacagcggccctgggctgcctggtcaaggactacttcctatacgatcg

SEQ ID NO: 787260 - DNA, 472 bp, Homo sapiens
  misc_feature: NA.49.35.D02.2.454.heavy.3.multim50
ttgggtttgggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 787261 - DNA, 576 bp, Homo sapiens
  misc_feature: NA.49.35.D02.5.454.heavy.3.multim50
ttgggtttgkkgrgytykgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctggggggggctggtccagcctgggaggtccctgagactctcctgtgcaggctctgcatttcccttcagtaactacgctatcgattgggtccgccaggctccaggcaagggactggagtgggtcgcagttatttcagctgatggaggcaataagtattacggagattctgcgaggggccgattcaccatatccagagacaactcccaagataatgatatatctgcaaatgaacagcctgagacctgaggacacggctatgtattattgtgcgtcagggggcagtgcctggccacgtgatgcttttgatttctggggtccaaggggacattcgtcaccgtctcgtcagcctccaccaagggcccatcggtcttccccctggccaccctcctccaagagcacctctggggc

SEQ ID NO: 787262 - DNA, 518 bp, Homo sapiens
  misc_feature: NA.49.35.D02.9.454.heavy.3.multim50
ttgggtttgggtatagacttgggtttggggggaagaggaagactgacggtccccccaggagttcaggtgctgggcacggtgggcaacttatgagcccgaaaggacatggccacggggtgggtagggacatagggccagatgccagcctgaggtggagcctcaggtcacaggtgggcacggacactatccacataagcgagggatagacccgagtgtccccacagcagacctgagagcgctgggcccacagcctcccctcagagccctgctgcctcctccggtcagccctggacatcccaggtttccccaggcctggcggtaggtttagaatgaggtctgtgtcactgtggtattacgatattttgactggtttggatgactcttacttctacttcttacgttatggacctctggggccaagggaccacggtcaccgtctcctcagcctccaccaagggcccatcggtcttccccctggcaccctcctccaagagcacctctcgggggcacagcggccc

SEQ ID NO: 787263 - DNA, 468 bp, Homo sapiens
  misc_feature: NA.48.27.C05.2.454.heavy.3.multim50
agggtttggggagctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcggtatttcacctacacakrgtcg

SEQ ID NO: 787264 - DNA, 644 bp, Homo sapiens
  misc_feature: NA.48.27.C05.3.454.heavy.3.multim50
agggtttggggtcagggtttgggggytctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctcggccgccctgctccaggagcacctccgagagcacagcggccctcgggctgcctggtcaaggactacttcctatgtatact

SEQ ID NO: 787265 - DNA, 632 bp, Homo sapiens
  misc_feature: NA.48.27.C05.5.454.heavy.3.multim50
agggtttggggtctgggagaggagctccagccttgggactcccagctgtctccactcggtgatcggcactgaatacaggagactcaccatggagtttgggctgagctgggttttccttgttgctattttaaaaggtgtccagtgtgaggtgcagttggtgcagtccgagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 787266 - DNA, 471 bp, Homo sapiens
  misc_feature: NA.48.27.C05.7.454.heavy.3.multim50
agggtttgggttttccttgttgctattttagaaggtgtccagtgtgaagtgcagctggtggagtctgggggaggcttggtccagcctggggggtccctaagactctcctgtgcagcctctggattcacctttagtacctattggatgacctgggtccgccaatctccagggggggggctggagtgggtggccaatataaagggagatggaagtgtgacacactatgtggactctgtgaagggccgattcaccatctccagagacaatgccaaggagtcactgtatctgcagatgaacagcctgagagccgaggacgcggctgtgtattactgtgcgagagatgcgaatccctctgatagtaatggtcgttattatgatgcttttgatatgtgggccaagggacaacggtcaccgtctcttcagcctccaccaagggcccatcggtcttcccctggccgcctcgctccagga

SEQ ID NO: 787267 - DNA, 514 bp, Homo sapiens
  misc_feature: NA.48.27.C05.9.454.heavy.3.multim50
agggtttggggatactttctgagagtcctggacctcctgtgcaagaacatgaaacacctgtggttcttcctcctcctggtggcaactcccagatgggtcctgtcccaggtgcagctgcaggagtcgggcccagggctggtgaagccttcggagaccctgtccctcacctgcagtgtctctgatgcctccgtcagcaacgaaaattattgttggacctggatccggcaggccccagggaaggcgccggagtggattggatataccggttctcgtcctgcgtacaccaatgacaatccccccctcaggagccgaatctccatatcactggacacgtccaagaaccggttctccctgaccctgaggtctgtgaccgctgcggacacggccgtctattactgtgcgaggattccccttggacacccattttcgggttacttttgaacttattgggggccaggggagccctggtccacccgtctccctcacgcctccaccaacggggccccagtcggtt

SEQ ID NO: 787268 - DNA, 520 bp, Homo sapiens
  misc_feature: NA.48.67.G01.2.454.heavy.3.multim50
ttgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaagggacctcggtcgtcccgtttcctcagcctccaccaacgggcccc

SEQ ID NO: 787269 - DNA, 440 bp, Homo sapiens
  misc_feature: NA.48.30.C08.5.454.heavy.3.multim50
aagggaaagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtatagcaaactacgcacagaagttccagggcagagtcacgattaccgcggacaaatccacgagcacagcctacatggagctgagcagcctgagatctgaggacacggccgtgtattactgtgcgagagatcagagtggttattt

SEQ ID NO: 787270 - DNA, 463 bp, Homo sapiens
  misc_feature: NA.18.78.H01.4.454.heavy.3.multim50
ctgggagaggagctccagccttgggattcccagctgtctccactcggtgatcggcactgaatacaggagactcaccatggagtttgggctgagctgggttttccttgttgctatttcaaaaggtgtccastgtgaggwgcagttggtggagactggaggargcytgatccagcckggggggtccctgagactstcctgtgyagtctctgggttcagcgtcagtsgcgacyacatgagytggktccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtattttgtgcgagcgacccggggctccgtcaatggctttcattactggggcacg

SEQ ID NO: 787271 - DNA, 355 bp, Homo sapiens
  misc_feature: NA.53.29.C07.3.454.heavy.3.multim50
agggaaaggggctggagtggattggggaagttcatcatagtggaagcaccaattacaacccgtccctcaagagtcgagtcaccatatcagtagacacgtccaagaaccagttctccctgaagttgagctctgtcaccgccgcggacacggctgtgtattactgtgcgagagttttggcaagttcgtctcgatttgacccttactttgacttctggggccagggaaccctggttaccgtctcctcagcctccaccaagggcccatcggtcttccccctggcaccctcctccaagagcacctctgggggcacagcggccctgggctgcctggtcaaggactacttcctcgtactgcg

SEQ ID NO: 787272 - DNA, 621 bp, Homo sapiens
  misc_feature: NA.48.24.C02.2.454.heavy.3.multim50
tagggaaaggggtctgagagaggagccttagccctggattccaaggcctatccacttggtgatcagcactgagcaccgaggattcaccatggaactggggctccgctgggttatccttgttgctattttagaaggtgtccagtgtgaggtgcagctggtggagtcagggggaggcctggtcaagcctggggggtccctgagactctcctgtgcagcctctggattcaccttcagtacctataccatgaactgggtccgccaggctccagggaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 787273 - DNA, 457 bp, Homo sapiens
  misc_feature: NA.52.62.F07.2.454.heavy.3.multim50
aagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactgggtccgccaggctccaggcaaggggctggagtgggtggcagttatatcatatgatggaagtaagatatactatgcagactccgtgaagggccgattcaccatttccagagacaactccaagaacacgctgtatttgcaaatgaacagcctgagagctgaggacacggctgtgtattactgtgcgtaacttaatcacggtaggacg

SEQ ID NO: 787274 - DNA, 618 bp, Homo sapiens
  misc_feature: NA.49.33.C11.1.454.heavy.3.multim50
ttgggtttgggcacgaccggtgctcgatttagagtgagctcgttgggtttggttgggtctgggagaggagcccagcactgggattccgaggtgtttccattcagtgatctgcactgaacacagaggactcgccattgggtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaagggcccatcggtcttcccctggcgccctgctccaggagcacctccgagagcacagcc

SEQ ID NO: 787275 - DNA, 628 bp, Homo sapiens
  misc_feature: NA.49.33.C11.2.454.heavy.3.multim50
ttgggtttggggtctgggagacgagcccagcactggaagtcgccggtgtttccattcggtgatcatcactgaacacagaggactcaccatkgagtttgggctgagctgggttttcctcgttgctcttttaagaggtgtccagtgtcatgtgcagttgattgggtttgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttccccctggccgccctgctccaggagcacctctgggggcacgagcggccctgggctgcctggtcaaggactacttcctctctcgta

SEQ ID NO: 787276 - DNA, 507 bp, Homo sapiens
  misc_feature: NA.48.62.F07.5.454.heavy.3.multim50
aagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtcttattactgtgcgaggccccgagccgcagtggtcgtttttgtattgtcckttkwstwwtrgtgkggtcygrrgggsmcgaaagkggtaaccgaamcgttcgsktccgtaacccgtccgttt

SEQ ID NO: 787277 - DNA, 637 bp, Homo sapiens
  misc_feature: NA.49.33.C11.4.454.heavy.3.multim50
ttgggtttggggctctgggagaggagcccagcactagaagtcggcggtgtttccattcggtgatcagcactgaacacagaggactcaccatkgrgtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagacttttatgacagtagtggtttctccgagtatgcacattacggcatggacgtctggggccaagggaccccggtcaccgtctccttagcctccaccaagggcccatcggtcttccccctggcaccctcctccaagagcacctctsggggcacagcggccctgggctgcctggtcaaggactacttcctctctcgact

SEQ ID NO: 787278 - DNA, 473 bp, Homo sapiens
  misc_feature: NA.49.33.C11.7.454.heavy.3.multim50
ttgggtttggggagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcattctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaaggacaccgccttctactactgtgacaaaagattacggtcgaccgacacctattttcga

SEQ ID NO: 787279 - DNA, 472 bp, Homo sapiens
  misc_feature: NA.49.33.C11.8.454.heavy.3.multim50
ttgggtttgggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtcgcacggtacggacgtctgggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 787280 - DNA, 632 bp, Homo sapiens
  misc_feature: NA.48.62.F07.2.454.heavy.3.multim50
aagggaaagggggggggaagaggaagactgacggtcctgccacaggtggtgctgggcacggtgggcactcgacacaacatttgcgctcaactgtcttgttcaccatggagtttgggctgagctggctttttcttgtggctattttaaaaggtgtccagtgtgaggtgcagttgttggagtctgggggagacctggtacagccgggggggtccttgaaactctcctgtgcagcctctggattcgattttggcagccatgccattacctgggtccgccagtctcaagggaaaggggctggacgggatctcgggaattagtgctgctagtggtagcagtttatacgcagactccgtgaagggccgattcaccatctccagagacaattccaagaacacggcgtatctgcagatgaacaacctgggcgtcgaggacacggccatttattactgtgcgaaatcctctggccgtgccgctaggtactttgagcactggggtccgggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 787281 - DNA, 478 bp, Homo sapiens
  misc_feature: NA.48.62.F07.4.454.heavy.3.multim50
aagggaaaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagacctctggatacaccttcacgaactgtgctattcattgggtgcgacaggcccctggacaagggcttgagtggatggggtggatcaacaccaacactgggaacccaacgtatgcccagggcttcacaggacgatttgtcttctccttggacacctctgtcaatacggcacatctgcagatcaccagcctgaagactgaggacactgccgtgtattcttgtgtgagacgaagtagtagctcgcccttcctttgactacgtgggccagggaaccctggtcaccgcctcc

SEQ ID NO: 787282 - DNA, 582 bp, Homo sapiens
  misc_feature: NA.48.20.B09.1.454.heavy.3.multim50
aggggctccctcactgcccagctgggatctcagggcttcattttctgtcctccaccatcatggggtcaaccgccatcctcgccctcctcctggctgttctccaaggagtctgtgccgaggtgcagctggtgcagggggagcacaattgaaaaagcccggggagtctctgaagatctcctgtgagggttctggatacagctttgccaactactggatcgcctgggtgcgccagatgcccgggaaaggcctggagtggatggggatcatctatcctggcgactctgataccagatacagcccgtccttccaaggccaagtcaccatctcagccgacaactccatcagcaccgcctacctgcagtggagcagcctgaaggcctcggacaccgccgtgtattactgtgcgagacatgattacggctactcacgtccgcactactggggccagggaaccctggtcaccgtctcctcagcttccaccaagggcccatcggtcttcccctggcgccctgctccaggagcacctctgggggcacagcggccctgggctgcctggtcaaggactacttcctatgtatactt

SEQ ID NO: 787283 - DNA, 475 bp, Homo sapiens
  misc_feature: NA.48.20.B09.2.454.heavy.3.multim50
  modified_base (451)..(451): a, c, t, g, unknown or other
aaagggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttcccctggcgccctgctccaggagcacctccgagagcacagcggccctgggctgcctggtcaaggactacttcctatgtatactnagtggcggtcggcgaggacggcga

SEQ ID NO: 787284 - DNA, 603 bp, Homo sapiens
  misc_feature: NA.48.45.E01.3.454.heavy.3.multim50
ctgggagaggagccccagccttggaattcccaagtgttttcattcagtgatcaggactgaacacagaggactcaccatggagtttgggctgagctggattttccttgctgctattttaaaaggtgtccagtgtgaggtgcagctggtgcaggtccggggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 787285 - DNA, 560 bp, Homo sapiens
  misc_feature: NA.48.45.E01.6.454.heavy.3.multim50
ctttctgagagtcagggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggttggatccgccagcccccagggaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacgggtgccccaagaaaagtgttttatccctggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 787286 - DNA, 467 bp, Homo sapiens
  misc_feature: NA.48.45.E01.8.454.heavy.3.multim50
tctgagagaggagcccagccctgggattctcaggtgttttcatttggtgatcaggactgaacagagagaactcaccatggagtttgggctgagctggctttttcttgtggctattttaaaaggtgtccagtgtgaggtgcacctgttggagtctgggggaggcttggtacagcctggggggtccctgagactctcctgtgcagcctctggattcacctttagcagctatgccatgagctgggtccgccaggctccagggacggggctggagtgggtctcagctattagtggtagtggtggtggcacatactacgcagactccgtgaagggccggttcaccatctccagagacaattccaagaacacactttatctgcgaatgaacgagcctgagagccgaggacacggccgtatattactgtgcgaaagaagtacagggttactatggatagtcgggaggagtttcg

SEQ ID NO: 787287 - DNA, 623 bp, Homo sapiens
  misc_feature: NA.48.45.E01.9.454.heavy.3.multim50
tctgggagacgagcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcttgtgcagcctctggattcattttcagtgactatggtatgcactgggtccgccaggctccaggcaaggggctggagtgggtggcagtcataccttctgctggaaggaatatctactacgcgggctccgtgaacgggccgattcaccatctccagagacaattccaacaagacactgtatctgcaaatgaacagcctgagggctgaagacacggctggtgtattactgtgcgaggaggctatcactatggttcggggttacktttcagggaaactggctcgacccctggggccagggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 787288 - DNA, 642 bp, Homo sapiens
  misc_feature: NA.52.53.E09.2.454.heavy.3.multim50
ttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctgggccgtggcaccctggtcactgtcttctcagcctccaccaasggcccatcggtcttccccctggcaccctcctccaagagcacctcgtgggggcacagcggccctgggctgcctggtcaaggactacttcctatacgatcg

SEQ ID NO: 787289 - DNA, 491 bp, Homo sapiens
  misc_feature: NA.52.53.E09.3.454.heavy.3.multim50
ttgggtttgggggctctgggagaggagcccagcactgggattccgaggtgtttccattcagtgatctgcactgaacacagaggactcgccatggagtttgggctgagctgggttttccttgttgctattttaaaaggtgtccagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctkgggccagggaacccgggtcaccgtctcctcagcctccaccaagggcccatcggtcttccccctggccaccctcctccaagacgcacctctc

SEQ ID NO: 787290 - DNA, 494 bp, Homo sapiens
  misc_feature: NA.52.53.E09.5.454.heavy.3.multim50
ttgggtttggggakctctgagagaggaggccagccctgggattttcaggtgttttcatttggtgatcaggactgaacagagagaactcaccatggagtttgggctgagctggctctttcttgtggctattttaaaaggtgtccagtgtgacgtacagctggtggagtcggggggagccttccaacacccggggggggtccctgagactcacctgtgaagcctctggatttagatttagcagccatgccatcgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcggaggacgaacggccggtttaattactgtgcgaaagatcgaggtcgcatgactagtttttggagtggccaaagacsgacg

SEQ ID NO: 787291 - DNA, 471 bp, Homo sapiens
  misc_feature: NA.48.70.G04.2.454.heavy.3.multim50
ctctgggagaggagccccagccctgagattcccaggtgtttccattcagtgatcagcactgaacacagaggactcaccatggagttgggactgaactggattttccttttggctattttaaaaggtgtccagtgtgaactgcaactggtggagtctgggggaggcttggtacagcctggcaggtccctgagactctcctgtgcagcctctggattcacctttggtgattatgccatgcactgggtccggcaagctccagggaagggcctggagtgggtctcaggtattagttggaatagtgatagcataggctatgcggactctgtgaagggccgattcaccatctccagagacaacgccaagaactccctgtatctgcaaatgaacagtctgagaactgaggacacggccttgtattactgtgtaaaagataatgatttttggggttcggggtagtttggaggcggttcg

SEQ ID NO: 787292 - DNA, 482 bp, Homo sapiens
  misc_feature: NA.40.85.H08.3.454.heavy.3.multim50
tcgcgggggtctcagagaggagccttagccctggactccaaggcctttccacttggtgatcagcactgagcacagaggactcaccatggaattggggctgagctgggttttccttgtagctattttagaaggtgtccagtgtgaggtgcagctggtggagtctgggggaggtttggtccagcctggggggtccctaagactctcctgtgcagcctctggattcacctttagtaccttttggatgacctggatgaacagcctgagacccgaggacgcggctgtgtattactgtgcgagagatgcgaatccgtctgacagcagtggtcgttactatgatgcttttgatatatggggccaagggacaacggtcaccgtctcttcagcctccaccaagggcccatcggtcttcccctggccgccctgctccaggaggcacctccgagacgcacaggccggcccgtcgggcctcgcctggtacgaac

SEQ ID NO: 787293 - DNA, 554 bp, Homo sapiens
  misc_feature: NA.49.86.H09.2.454.heavy.3.multim50
ttgggtttggggaatgactctagaagtctcccacatctgaccttgggtttgggtatagacttgggtttggggggaagaggaagactgacggtccccccaggagttcaggtgctgggcacggtgggcaacttatgagcccgaaaggacatggccacggggtgggtagggacatagggccagatgccagcctgaggtggagcctcaggtcacaggtgggcacggacactatccacataagcgagggatagacccgagtgtcccccacagcagacctgagagcgctgggcccacagcctcccctcagagccctgctgcctcctccggtcagccctggacatcccaggtttccccaggcctggcggtaggtttagaatgaggtctgtgtcactgtggtattacgatattttgactggtttggatgactcttacttctacttctacgttatggacctctggggccaagggaccacggtcaccgtctcctcagcctccaccaagggccccatcggtcttccccctggccaccctcctccaagagcacctctgggggcacg

SEQ ID NO: 787294 - DNA, 585 bp, Homo sapiens
  misc_feature: NA.49.86.H09.5.454.heavy.3.multim50
ttgggtttggggctctgggagaggagcccagcactagaagtcggcggtgtttccattcggtgatcagcactgaacacagaggactcaccattgggtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagactttatgacagtagtggtttctccgagtatgcacattacggcatggacgtctggggccaaggggaccccggtcaccgtctccttagcctccaccaagggcccatcggtcttcccctggccaccctcctccaagagcacctctc

SEQ ID NO: 787295 - DNA, 500 bp, Homo sapiens
  misc_feature: NA.51.30.C08.4.454.heavy.3.multim50
aagggaaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcactgtctctggtggctccatcagcagcagtagttacttctggggctggatccgccagcccccagggaagggactggagtggatagggaatgtccattatagtgggagcacctactacaatccgtccctcaacagtcgagtcaccatatccgttgacacgtccaagaaccaattcttcctgaggctgacctctgtgaccgccgcagatacggcagtttattactgtgcaagaaagaactaccttgaaaactggggccacggaaccctggtcaccgtctcctcagcctccaccaagggcccatcggtcttcccccggccacccgtcctccaa

SEQ ID NO: 787296 - DNA, 635 bp, Homo sapiens
  misc_feature: NA.53.38.D05.2.454.heavy.3.multim50
ttgggtttggggtctgagagaggagccttagccctggattccaaggcctctccacttggtgatcagcacttagcaccgaggattcaccatggaactggggctccgctgggttttccttgttgctttttagaaggtgtccagtgtgacatgcagctggtggagtctgggggaggcctggtyrrgtyygggggggtccctgagactctcctgtgcagcctctggattcaccttcagtatttatagcatgaattggatccgccaggctccagggaaggggctcgagtgggtctcatccattagtagtagtagtagttacaaatactacgcagactcagtgaagggccgattcaccgtctccagagacaacgccaagaactcactgtatctgcaaatgaatagcctgagagccgaggacacggctgtatatttctgtgcgagagatgacccatataacagtgactacttactctgtggatgatgcttttgatgtctggggccaagggacaatagtcaccgtctcttcagcctccaccaaggcccatcggtcttcccctcggcaccctcctccaacgagcacctctgggggcacagcggccctcgggctgcctggtcaaggactacttcctcgtactgcg

SEQ ID NO: 787297 - DNA, 494 bp, Homo sapiens
  misc_feature: NA.52.29.C07.1.454.heavy.3.multim50
agggaaagggggctctgggagaggagcccagcactgggattccggggtgtttccattcagtgatctgcactgaacacagaggactcgccatggagtttgggctgagctgggttttccttgttgctattttaaaaggtgtccattgtgaggtgcagctggtggagtctgggggaggcttggtccagccgggggggtccctgagactctcctgtgcagcctctgaattcagcgtcagtagcgactacatgagctgggtccgccaggctccagggaaggggctggagtgggtcacagttattccaaccggtgggagcgcacactacgcagattccgtgaagggcaggttcaccatctccagagacaatttgaggaacacggtgcatcttcacatgaacagcctgagagccgaggacacggctgtttattactgtgcgagggtaaattggaactacgcgggggacttcgacccktggggccagggaacctctcaccgt

SEQ ID NO: 787298 - DNA, 515 bp, Homo sapiens
  misc_feature: NA.48.78.H01.1.454.heavy.3.multim50
atgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaagggacctcggtccgccgttttcctcacgtccctccaaccaacgggccctacg

SEQ ID NO: 787299 - DNA, 469 bp, Homo sapiens
  misc_feature: NA.48.78.H01.3.454.heavy.3.multim50
cacccaacaaccacacccctcctaagaagaagcccctagaccacagctccacaccatggactggacctggaggatcctcttcttggtggcagcagcaacaggtgcccactcccaggtgcagttggtgcaatctgggtctgatttgaagaagcctggggcctcagtgaaggtttcctgcagggcttctggatactccttcactgactatggtatcaattgggtgcgacaggcccctggccaagggcttgagtggatggggtggatcgacaccaacactgggaacccaacacatgcccggggcttcaaaggacggtttgacttctccttggccacctctgtcagcacggcatatctgcagatcagcagcctaaagcctgaggacactgccgtgttttattgtgcgagatccaggcgagggaggataccgattcttatatagcgactactactacttcggaatggacgttcg

SEQ ID NO: 787300 - DNA, 555 bp, Homo sapiens
  misc_feature: NA.49.12.B01.2.454.heavy.3.multim50
tccgcgggcacgaccggtgctcgatttagtagtgtagattccgcgggcacgaccggtgctcgatttagtagtgtagatccgcggggagctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggcttatttattactgtgcgaacttaatcacggaggacaaggggtcgacccccgtccaccg

SEQ ID NO: 787301 - DNA, 411 bp, Homo sapiens
  misc_feature: NA.49.12.B01.3.454.heavy.3.multim50
tccgcgggcacgaccggtgctcgatttagtagtgtagattccgcgggcacgaccggtgctcgatttagtagtacgactgaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 787302 - DNA, 467 bp, Homo sapiens
  misc_feature: NA.48.53.E09.4.454.heavy.3.multim50
ttgggtttggggagctctcagagaggtgccttagccctggattccaaggcatttccacttggtgatcagcactgaacacagaggactcaccatggagctggggctgtgctgggtcttccttgttgcttttttagaaggtgtccagtgtgaggtgcatctggtggagtctgggggagccttggtgcagcctggagagtccctaagactctcctgcgcagcctcaggattcagtttcagtagttatgaaatgaattgggtccgccaggctccagggaagggactggagtggcttttcatatattactggcagtgggtctcttacccattatgcagactctgtgaggggccgattcaccatctccagagacaaccccgaaactctctttttctgcaaatggacagcctgacagccgacgatacggcctattttattactgtgcgagagatsgggacccccgcactatacc

SEQ ID NO: 787303 - DNA, 483 bp, Homo sapiens
  misc_feature: NA.53.76.G10.1.454.heavy.3.multim50
aggggttgggggcaacttataaacccaaaaggaatggccatgcagcgggtagggacaatacagacagatctcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcaggcctggacatcccgggtttccccaggcctggcggtaggtttggggtgaggtctgtgtcactgtggtatgacgatttttggcgtggtttttccttcactattactcccactactacggtttggacgtctggggccaagggaccacggtcaccgtctcctcagcctccaccaagggcccatcggtcttcccctggcaccctcctccaagagcacctctgggggcacagcggccctgggctgcctggtcaaggactacttcctcgtactgcg

SEQ ID NO: 787304 - DNA, 518 bp, Homo sapiens
  misc_feature: NA.40.12.B01.1.454.heavy.3.multim50
tccgcgggcacgaccggtgctcgatttagtagtgtagatccgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccacgtcggggccaggggaaacccgggtacc

SEQ ID NO: 787305 - DNA, 468 bp, Homo sapiens
  misc_feature: NA.11.57.F02.2.454.heavy.3.multim50
tttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgccaggctccaggtaaggggctggaatggatttcatacattagcagtagtggtgcgaccatatactacgcagactctgtgaagggccgattcatcatctccagagacaatggcaacaactcactgtatctggaaatcaacagcctgagagtcgaggacacggtc

SEQ ID NO: 787306 - DNA, 466 bp, Homo sapiens
  misc_feature: NA.13.10.A10.2.454.heavy.3.multim50
agggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagttggaagtgagaaatactatgtggactctgtgaagggccgattcaccatctccagagacaacgccaagaactcactgtatctgcaaatgaacagcctgagagccgaggacacggctgtctattactgtgcgagagagttgggggcggaaggtatagcagtggctacg

SEQ ID NO: 787307 - DNA, 470 bp, Homo sapiens
  misc_feature: NA.48.33.C11.1.454.heavy.3.multim50
ttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttacagttggttcggggagtctccgacccagcaactggttaccgg

SEQ ID NO: 787308 - DNA, 633 bp, Homo sapiens
  misc_feature: NA.48.33.C11.2.454.heavy.3.multim50
ttgggtttggggtgggagaggagctccagccttgggactcccagctgtctccactcggtgatcggcactgaatacaggagactcaccatggagtttgggctgagctgggttttccttgttgctattttaaaaggtgtccagtgtgaggtgcagttggtgcagtccgggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctagttggggccaacgaaccctggtcgccgtctcctcagcctccaccaagggcccatcggtcttccccctggcgccctgctccaggagcacctccgagagcacagcggccctgggctgcctggtcaaggactacttcctatgtatact

SEQ ID NO: 787309 - DNA, 629 bp, Homo sapiens
  misc_feature: NA.48.33.C11.4.454.heavy.3.multim50
ttgggtttgggggctctgggagacgagcccagcactggaagtcgccggtgtttccattcggtggctcagcactgaacacagaggactcaccatggagtttgggctgaactgggttttcctcgttgctcttttaagagatgttgggtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 787310 - DNA, 446 bp, Homo sapiens
  misc_feature: NA.48.33.C11.5.454.heavy.3.multim50
ttgggtttggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagatatac

SEQ ID NO: 787311 - DNA, 501 bp, Homo sapiens
  misc_feature: NA.48.33.C11.7.454.heavy.3.multim50
ttgggtttggggagtgactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgttacacacaccatcttgacgacgtgggggatgcttttcatttctgggggccgagggggaccggtgggtcgccggtgtctacagcctccaccaasggcccatcggtccttcccctctggccta

SEQ ID NO: 787312 - DNA, 622 bp, Homo sapiens
  misc_feature: NA.48.37.D04.2.454.heavy.3.multim50
gttgggtttggggagctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcggatttcacctacacgagggctggttcgacccctggggccagggaaccctagtcaccgtctcctcagcctccaccaagggcccatcggtcttcccctggcaccctcctccaagagcacctctgggggcacagcggccctgggctgcctggtcaaggactacttcctatgtatact

SEQ ID NO: 787313 - DNA, 666 bp, Homo sapiens
  misc_feature: NA.48.37.D04.3.454.heavy.3.multim50
ttgggtttgggcacgaccggtgctcgatttagatcgtttgggtttggggttggtgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctcgctccaggagcacctccgagagcacagcggccctgggctgcctggtcaaggactacttcctatgtatact

SEQ ID NO: 787314 - DNA, 573 bp, Homo sapiens
  misc_feature: NA.48.37.D04.6.454.heavy.3.multim50
ttgggtttggggtctgggagtggagccccagccttgggattcccaagtatttgtattcagtgatcaggactgaacacacaggactcaccwtggrkttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaaggtctggagtgggtctcagtcatgggtacagctggtcacacatactatgcagacctccgtaaagggccgattcaccatctccagagaagacgccaagaattccttgtatcttcagatgaacagtctgagaaccgatgacacggctgtgtaattattgtgcrmaaaggggggagcagctcgtccatycacttcgactcctggggccagggaaccctggtcaccgtctcctcagcctccaccaagggcccatcggtccttcccccgtggccacccctcctcccaagacgccaccctcgtc

SEQ ID NO: 787315 - DNA, 494 bp, Homo sapiens
  misc_feature: NA.48.37.D04.8.454.heavy.3.multim50
ttgggtttggggagtgactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcrtctctgaagaccagactctccatcaccaaggacacctccaagaacgaggttgtcctttycytggccaacatgcaccctgtggacacggccactttactttttgttacacacaccatcttgacgactggggatgcttttcatttcgtcggggccgaggggaccgtggtcgccgtgtctacagcctccaccaagggcccagtcggttccttcccccgt

SEQ ID NO: 787316 - DNA, 445 bp, Homo sapiens
  misc_feature: NA.48.37.D04.9.454.heavy.3.multim50
ttgggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctatttattgttccagagataatcgcgtgaataaagat

SEQ ID NO: 787317 - DNA, 595 bp, Homo sapiens
  misc_feature: NA.49.30.C08.1.454.heavy.3.multim50
aagggaaagggggggagaggagcccagcactgggattccgaggtgtttccattcagtgatctgcactgaacacagaggactcgccatggaatttgggctgagctgggttttccttgttgctattataaaaggtgtccagtgtgaggtgcaactggtgcagtctgggggaggcttggtccagcctgggatttccctgagactctcctgtgcagcctctggagtcaccgtcagcaacaactacatgagctgggtccgccaggctcaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 787318 - DNA, 491 bp, Homo sapiens
  misc_feature: NA.49.30.C08.3.454.heavy.3.multim50
aagggaaaggggactccaaggcctttccacttggtgatcagcactgagcacagaggactcaccatggagttggggctgagctgggttttccttgttgctattttagaaggtgyccagtgtgaggtgcagctggtggactcggggggaggcttggtccagcctgggggttccctgagactctcctgtgtagtctctggattcagctttaggagttattacatgagttgggtccgccaggctccagggaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtcggcccaaacccattacggagccgacgggaacccgtagttcgaagcggtcctcctctagccctccaacccg

SEQ ID NO: 787319 - DNA, 483 bp, Homo sapiens
  misc_feature: NA.53.35.D02.1.454.heavy.3.multim50
ttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggtacg

SEQ ID NO: 787320 - DNA, 447 bp, Homo sapiens
  misc_feature: NA.48.53.E09.1.454.heavy.3.multim50
ttgggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagatata

SEQ ID NO: 787321 - DNA, 582 bp, Homo sapiens
  misc_feature: NA.48.53.E09.7.454.heavy.3.multim50
ttgggtttggggaggtctcagagaggagccttagccctggactccaaggcctttccacttggtgatcagcactgagcacagaggactcaccatggaattggggytgrgtytgggttttccttgttgctattttagaaggtgtccagtgtgaagtgcagctggtggagtctgggggaggcttggtccagcctggggggtccctaagactctcctgtgcagcctctggattcacctttagtacctattggatgacctgggtccgccaatctccaggggggggggctggagtgggtggccaatataaagggagatggaagtgtgacacactatgtggactctgtgaagggccgattcaccatctccagagacaatgccaaggagtcactgtatctgcagatgaacagcctgagagccgaggacgcggctgtgtattactgtgcgagagatgcgaatccctctgatagtaatggtcgttattatgatgctttgatatgtggggccaagggacaacggtcaccgtctcttcagcctccaccaacgggcccatcggtcttccccctggccgccctcgcctccaggacg

SEQ ID NO: 787322 - DNA, 499 bp, Homo sapiens
  misc_feature: NA.49.41.D08.1.454.heavy.3.multim50
tctgggagacgagcccagcactggaagtcgccggtgtttccattcggtgatcatcactgaacacagaggactcaccatggagtttgggctgagctgggttttcctcgttgctcttttaagaggtgtccagtgtcaggtgcttctggtggactctgggggaggcgtggtccggcctgggaggtccctgagactctcctgtgcagcctctcagttcaccttcagtgtctatactatgcactgggtccgccaggctccaggcaaggggctggagtgggtggcacttatatcaaatgatggaagaattcaacactacgcaggctccgtgaagggccgattcaccatctccagagacaattccaagaacacactgtctctgcaaatgaatagcctgagagttgaggacacggctgtctattactgtgcgagagctaagggacttactcatagatttgtactactggagccgagggacgccctggtaccaccggtcctcctcagt

SEQ ID NO: 787323 - DNA, 478 bp, Homo sapiens
  misc_feature: NA.49.41.D08.3.454.heavy.3.multim50
tctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaagccgggggggtccctgagactctcctgtgcagcctctggattcaccttccgttcctataccatgaactggatccgccaggctccagggaggcgactggagtgggtctcatctattagtggtagaggtgattactacaactacgcagactcactggagggccgattcaccatcctccagagacaacaccaagaatttactgtatctgcaaatggacagcctgagagccgacgacacggctgtctattactgtgcgagagttcggggataattgccgtagtcccagatgtcccgacctaacggttcccg

SEQ ID NO: 787324 - DNA, 574 bp, Homo sapiens
  misc_feature: NA.49.41.D08.6.454.heavy.3.multim50
aatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagcccccagggaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 787325 - DNA, 464 bp, Homo sapiens
  misc_feature: NA.49.41.D08.10.454.heavy.3.multim50
agccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcctagttcagcctggggggtccctgagactctcctgtgcagcctctggattcaccttcagtagctactggatggactgggtccgccaagctccagggaaggggctggtgtgggtctcacgtattaatagtgatgggagtagaaaaagctacgcggactccgtgaagggccgattctccatctccagagacaacgccaagaacacgctgtatctgcaaatgaacagtctgagagccgaggaaacggctagtgtattactgtgcagggtatcgaccgcgacacaaaattcgagatacagcccagtgactacgtc

SEQ ID NO: 787326 - DNA, 552 bp, Homo sapiens
  misc_feature: NA.48.28.C06.2.454.heavy.3.multim50
tctgggagtggagccccagccttgggattcccaagtatttgtattcagtgatcaggactgaacacacaggactcaccatggagttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaaggtctggagtgggtctcagtcatgggtacagctggtcacacatactatgcagactccgtaaagggccgattcaccatctccagagaagacgccaagaattccttgtatcttcagatgaacagtctgagaaccgatgacacggctgtgtattattgtgcgaaaaggggggagcgagctcgtccatccacttcgactcctggggccagggaaccctggtcaccgtctcctcagcctccaccaagggcccatcggtcttccccctggccaccctcctccaagagcacctctc

SEQ ID NO: 787327 - DNA, 470 bp, Homo sapiens
  misc_feature: NA.48.28.C06.3.454.heavy.3.multim50
atgctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttccgaccccgtgggggcccaggggataccgtsgtcaccg

SEQ ID NO: 787328 - DNA, 503 bp, Homo sapiens
  misc_feature: NA.48.28.C06.5.454.heavy.3.multim50
atgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaagggacctcggtcgtccgtttcctcagscctccaccaaggg

SEQ ID NO: 787329 - DNA, 476 bp, Homo sapiens
  misc_feature: NA.13.55.E11.2.454.heavy.3.multim50
ttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttcgactctcctgtgcagcctctggaatcactttcagtgacgcctggatgaactgggtccgccaggctccagggaaggggctggagtggattggccgtattaaaagtgagcctgatggtgggacaacagactacgctgcacccgtgaagggcagattcaccatctccagagatgattcaaggaacacagtgtttctgcaaatgaacagcctgactgccggggacactgccgtgtattactgtgccagcagcagtacctggccactattattttttgtactttctc

SEQ ID NO: 787330 - DNA, 472 bp, Homo sapiens
  misc_feature: NA.13.55.E11.5.454.heavy.3.multim50
ttgggtttggggagctctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggaggtttggtacagccagggcggtccctgagactctcctgtataacttctggattcaacttgggtgattatgctatgaactgggtccgccaggctccagggaaggggctggagtgggtaggtttcattaggagcaattctcatgatgggacaacagaatacgccgcgtctgtaaaaggcagattcaccatctcaagagatgagtccagaagcatcgcctttctgcagatgagtagcctgaagaccgaggacacagccatctattactgtgctagagagtattgctagtcctacgtacc

SEQ ID NO: 787331 - DNA, 457 bp, Homo sapiens
  misc_feature: NA.53.27.C05.1.454.heavy.3.multim50
agggtttggggacccaacaaccacatccctcctcagaagcccccagagcacaacgcctcaccatggactggacctggaggatcctctttttggtggcagcagccacaggtgcccactcccaggtccagcttgtgcagtctggggctgaggcgaagaagcctggggcctcagtgaaggtttcctgccaggcttctggatacaccctcagtacccatgctatccattgggtgcgccaggcccccggacaaagacttgagtggatgggatggatcagcgctggcaatggtgacagacactattcacagaagttccagggcagagtcaccatcaccagggacacatccgcgagcacagcctacatggaactgagcagcctgagatctgaagacacggggtgtatattactgtgcgagagggaagtgggatagttgtagatgcgccaggtcgcccgggcccc

SEQ ID NO: 787332 - DNA, 341 bp, Homo sapiens
  misc_feature: NA.53.27.C05.3.454.heavy.3.multim50
agggtggggggtcttgatcctgaaaatggtggaagagtctacgcgcagaagtttcagggcagagtcaccgtgacccaggacacatctagagacacagcctacatggaactcagaagcctgaggtctgaagacacggccgtctattattgtacaacccttgttgttcgggaggattgggctgacaattggttcgacccctggggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 787333 - DNA, 628 bp, Homo sapiens
  misc_feature: NA.52.86.H09.1.454.heavy.3.multim50
ttgggtttgggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccccggccaccctcctccaagagcacctctgggggcacagcggccctgggctgcctggtcaaggactacttcctac

SEQ ID NO: 787334 - DNA, 515 bp, Homo sapiens
  misc_feature: NA.18.14.B03.3.454.heavy.3.multim50
ttgggctgagctgggttttccttgttgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctctggggccaagggaccacggtcaccgtctcctcagcctccaccaagggcccatcggtcttcccctggcgccctgctccaggagcacctccgacgagcacagccggccccgtgggtccgcggtcg

SEQ ID NO: 787335 - DNA, 462 bp, Homo sapiens
  misc_feature: NA.49.57.F02.3.454.heavy.3.multim50
ttgggtttggggatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgaacacagcctacatggaactgcgcagcctaggatctgccgacacggccgtatatttctgtgcgagagagatgtctttctatgatagtactagtcattatgcttcktg

SEQ ID NO: 787336 - DNA, 616 bp, Homo sapiens
  misc_feature: NA.49.57.F02.4.454.heavy.3.multim50
ttgggtttggggctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgacaaaagattacggtgaccacaccttaattttgaaccactcgcggccagggaacccctagtcaccgtctcctcagcctccaccaagggcccatcggtcttccccctggcaccctcctccaagagcacctctgggggcacagcggccctgggctgcctggtcaaggactacttcctctctcgact

SEQ ID NO: 787337 - DNA, 476 bp, Homo sapiens
  misc_feature: NA.49.57.F02.6.454.heavy.3.multim50
ttgggtttggggttgaagtgaagaagcctggggcctcggtgaaggtttcctgcaaggcatctggatacagcttgaccaactactatatacagtgggtgcgacaggcccctggacaagggcttgagtggatgggaagaatcaaccctaatgatggaagtacaacaaacgcgcagaaatttcagggcagaataaccctgaccagggacacgtccacgagcacagtctacatggaattgagcagcctgagatctgaagacacggccgtctattactgtgccagagaatatcgttttatagtgggagctgccccacgatcgccattccactttgactactggggccagggaacactggtcaccgtctcctcagcctccaccaagggcccatcggtcttcccctggcaccctcctccaagagcacctctgggggcacagcggccctgggctgcctggtcaaggactactcctctctcgact

SEQ ID NO: 787338 - DNA, 543 bp, Homo sapiens
  misc_feature: NA.49.57.F02.7.454.heavy.3.multim50
ttgggtttgggtagttgggtttggggggaagaggaagactgacggtcctcccaggagttcaggtgctgggcaccgtgggcatgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttcccctggccgccctcgctccasgagcacctctgggggcacagcggccctgggctgcctggtcaaggactacttcctctctcgta

SEQ ID NO: 787339 - DNA, 468 bp, Homo sapiens
  misc_feature: NA.49.62.F07.2.454.heavy.3.multim50
aagggaaagggtctgtgaagccttcacagaccctgtccctcacctgcgctgtctctggtggctccatcaccagtggtggttattcctggacttggatccggcagccaccagggaaggccctggagtggattgggcacatctatcatagtgggaccacctactacaacccgtccctccagagtcgagtcaccatatcagtcgacatgtccgagaaccagttctccctgtacctccactctgtgaccgccgcggacacggccgtctattactgtgccagaggggaactctacttcggggagttaggaatcgctcctgcatttgacatctggggccagggaaacctggtcaccgtctcctcagcctccaccaagggcccatcggtcttcccctggcaccctcctccaagagcacctctgggggcacagcggccctgggctgcctggtcaaggactacttcctctctcgact

SEQ ID NO: 787340 - DNA, 332 bp, Homo sapiens
  misc_feature: NA.49.62.F07.3.454.heavy.3.multim50
aagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 787341 - DNA, 587 bp, Homo sapiens
  misc_feature: NA.49.62.F07.5.454.heavy.3.multim50
aagggaaaggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagccccmagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtytggggccaagggaccacggtcaccgtctcctcagcctaccaccaagggcccatcggtcttccccctggcaccctcctccaagagcacctctgggggcacagcggccctgggctgcctggtcaaggactacttcctctctcgact

SEQ ID NO: 787342 - DNA, 599 bp, Homo sapiens
  misc_feature: NA.49.59.F04.1.454.heavy.3.multim50
tagggattgggggcatcacataacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccagggaaccctggtcaccgtctcctcagcctccaccaagggcccatcggtcttccccctggcaccctcctccaagagcacctctgggggcacagcggccctgggctgcctggtcaacgactacttcctctctcgact

SEQ ID NO: 787343 - DNA, 682 bp, Homo sapiens
  misc_feature: NA.49.59.F04.2.454.heavy.3.multim50
tagggattggggggattggggggaagaggaagactgacggtcctcccaggagttcaggtgctgggcaccgtgggcatgggggaggtgtgtcatagggattggggtctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacagtctgagacgtgaagacacggctgtctattactgtgcgactgagatgtcttattacgatgccagtgctttagtaccgttcgacccgtggggccagggagccctggtcaccgtctcctcagcttccaccaagggcccatcggtcttcccctggccgccctgctccaggagcacctctggggcacagcggcccg

SEQ ID NO: 787344 - DNA, 533 bp, Homo sapiens
  misc_feature: NA.51.28.C06.2.454.heavy.3.multim50
agctctgggagacgagcccagcactggaagtcgccggtgtttccattcggtgatcatcaccgaacacagaggactcaccatggagtttggactgagctgggttttcctcgttgctcttttaagaggtgtccagtgtcaggtgcagctggtggactctgggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaaattatgcagactccgtgaagggccgattcaccatctccagagacaattccaagaacactctatatttgcagatgaatagcctgagaattgaggacacggctgtgtattactgtgtgagagggtcggtcatattccgggtttttggagtaattatctatgggaacttttgatatctggggccacgggacaatggtcaccgtctctcagcttccaccaaggccc

SEQ ID NO: 787345 - DNA, 607 bp, Homo sapiens
  misc_feature: NA.51.28.C06.3.454.heavy.3.multim50
agctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggccaccctcctccaagagcacctctgggggcacagcggccctgggctgcctggtcaaggactacttcctcgtagcact

SEQ ID NO: 787346 - DNA, 507 bp, Homo sapiens
  misc_feature: NA.51.28.C06.6.454.heavy.3.multim50
ctgagctgggttttcctcgttgctcttttaagaggtgtccagtgtcaggtgcacctggtggagtctggggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctcccagagacaattccgggaacgacactgtctctgcaaatgaacagcctgagagctgaggacagggcgtgtttattactgtgtgcgatccgacctcactggtacggggagttacttcctccgcaacggtatggacgtctggggccaagggaccacggtcaccgtctccttagtcctcacwrscmawcgtskcccygmwcckstcywmcmsccttcgggccaccctcccctccaacgacggacacccttccg

SEQ ID NO: 787347 - DNA, 527 bp, Homo sapiens
  misc_feature: NA.53.34.D01.1.454.heavy.3.multim50
tttgggtttggggctgggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtggtttccatgatgcttttgatgtcggttggggrccaagggacaatggtcaccgtcctmcttcagcctcctacccgaccc

SEQ ID NO: 787348 - DNA, 485 bp, Homo sapiens
  misc_feature: NA.53.34.D01.3.454.heavy.3.multim50
ttgggtttgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgaccccgtggggccagggaaccctggtcaccgtctcctcagcttccaccaagggcccatcggtcttcccctggccgccctgcctccaggacgcacctcgtgggggcacagcggccctggggctcggccttgggtcaaagggacctacttcctcggttactggccg

SEQ ID NO: 787349 - DNA, 562 bp, Homo sapiens
  misc_feature: NA.48.26.C04.3.454.heavy.3.multim50
agacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtggaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccggtctcctcagcctccaccaagggcccatcggtcttcccctggccgccctgcctccgaggagcacctccgg

SEQ ID NO: 787350 - DNA, 626 bp, Homo sapiens
  misc_feature: NA.48.34.D01.1.454.heavy.3.multim50
ttgggtttgggctctgggagacgagcccagcactggaagtcgccggtgtttccattcggtgctcagcactgaacacagaggactcaccatggagtttgggctgaactgggttttcctcgttgctcttttaagagatgtccagtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 787351 - DNA, 489 bp, Homo sapiens
  misc_feature: NA.49.34.D01.2.454.heavy.3.multim50
tttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatggggatttgactactgggggccaggggaaccccggtcaccgtctccctctcgcctccccg

SEQ ID NO: 787352 - DNA, 572 bp, Homo sapiens
  misc_feature: NA.49.34.D01.6.454.heavy.3.multim50
ttgggtttgggggggagaggagcccagcactgggattccgaggtgtttccattcagtgatctgcactgaacacagaggactcgccatggagtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagastcccccgggtatagcagtgtctggtacatattactggggccgaaccctggtcaccgtctcctcagcctccaccaagggcccatccggtcttccccctgggccgccctgctccaggagcacctccgagagcacagcc

SEQ ID NO: 787353 - DNA, 465 bp, Homo sapiens
  misc_feature: NA.49.78.H01.1.454.heavy.3.multim50
catcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgaacacagcctacatggaactgcgcagcctaggatctgccgacacggccgtatatttctgtgcgagagagatgtctttctatggatagtactagtcattatgtctygattatttggggaccg

SEQ ID NO: 787354 - DNA, 622 bp, Homo sapiens
  misc_feature: NA.49.78.H01.3.454.heavy.3.multim50
ctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttcccccbkcggtccgccctgctccaggagcgacctctgggggcacgagcggccctcgggctgcctggtcaaggactacttcctctctcgactc

SEQ ID NO: 787355 - DNA, 615 bp, Homo sapiens
  misc_feature: NA.49.78.H01.6.454.heavy.3.multim50
agaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcytgtgyagyctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaaccccgtccgcacggtacggacgtctggggccaagggaccacggtcaccgtctcctcacgcctccaccaagggcccatcggtcttccccctggcaccctcctccaacgagcacctctcgggggcgacagcggccctgggctgcctggtcaaggactacttcctctctcgact

SEQ ID NO: 787356 - DNA, 658 bp, Homo sapiens
  misc_feature: NA.40.35.D02.2.454.heavy.3.multim50
  modified_base (633)..(633): a, c, t, g, unknown or other
ttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggagtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccggggaatcctggtcaccgtctcctcagcctccaccaagggcccatcggtcttcccctggcgccctgctccaggagcacctccgagagtacagcggccctgggctgcctggtcaaggactacttccagtcgctagacgtacgtacgcgtagngggcggcggtcgacggacggcgacg

SEQ ID NO: 787357 - DNA, 531 bp, Homo sapiens
  misc_feature: NA.49.38.D05.3.454.heavy.3.multim50
ttgggtttggggggaagaggaagactgacggtcctcccaggagttcaggtgctgggcaccgtgggcatgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttcccctggccgccctgctccacggacgctacctctgggggcacagcggccctgggctgcctggtcaaggactacttcctctctcgta

SEQ ID NO: 787358 - DNA, 460 bp, Homo sapiens
  misc_feature: NA.49.38.D05.5.454.heavy.3.multim50
ttgggtttggggatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgaacacagcctacatggaactgcgcagcctaggatctgccgacacggccgtatatttctgtgcgagagagatgtctttctatgatagtactagtctattatgcttc

SEQ ID NO: 787359 - DNA, 603 bp, Homo sapiens
  misc_feature: NA.48.14.B03.1.454.heavy.3.multim50
tccgcgggggtctcagagaggagccttagccctggactccaaggcctttccacttggtgatcagcactgagcacagaggactcaccatggaattggggctgatctgggttttccttgttgctctttttggaggtgtccactgtgaggtgcaactggtggaatctgggggaggcttggtccagcctgggggctctctcagactctcctgtgaaacctctggattcacctttacgactttttggatgggttgggtccgccaggccccagggaaggggctgcagtgggtggccaacacaaatcaaaatggaaacgtggagtactatgcggagtctgtgaagggccggttcaccatctacagagacaacggcaagaagtcgctgtttctgcaaatgaacagcctgacctccgacgacacggctctctattattgtgtgagagaatcctggggaccggccgtcttcgggggccagggaacactggttatcgtctcttcacgtccaccaagggcccatcggtcttccccctggcgccctgctccaggagcacctccgagagcacagcggccctgggctgcctggtcaaggactacttcctatgtatact

SEQ ID NO: 787360 - DNA, 637 bp, Homo sapiens
  misc_feature: NA.51.87.H10.4.454.heavy.3.multim50
ttgggtttggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtytgggtttggaggcgtggtccagcctgggaggtccctgagactctcttgtgcagcctctggattcaccttcagggtctatgacatgcactgggtccrccaggctccgaggcaaggggctggagtgggtggcagttatatcatatgatggaagcaagatatactattgtagactccgtgaagggccgattcatcatctccagagacaactccgagaacacgctgtatctgcaaatgaacaggctgagagctagaagacgacggctgtatattactgtgcgaacttaatcacggaggacaacggtgacccccgtcgctcggtgcggaggtctggggccaagggaccacggtcatcgtctcctcagcctccaccaagggcccatcggtcttcccccgtggcaccctcctccaagagcacctctgggggcacagcggccctgggctgcctggtcaaggactacttcctcgtacg

SEQ ID NO: 787361 - DNA, 475 bp, Homo sapiens
  misc_feature: NA.52.33.C11.4.454.heavy.3.multim50
ttgggtttgggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcaccatcaccagggacacatccgcgagcacagcctacatggagttgagcagcctgagaaatgaagacacggctgtatattactgtgcgagaggggaaatggggtaaggagtttttgggagtaaattatttatcctggcggtgcggacgtcgtc

SEQ ID NO: 787362 - DNA, 471 bp, Homo sapiens
  misc_feature: NA.48.82.H05.2.454.heavy.3.multim50
cacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgtacgttttggggccagggtaaaccg

SEQ ID NO: 787363 - DNA, 469 bp, Homo sapiens
  misc_feature: NA.48.82.H05.7.454.heavy.3.multim50
cacgaccggtgctcgatttagatcgtctgtgttgggakktgkggksmagcctrggaagtccctgacactgtcctgcrcagcctctggattcaccttcaccacctttcgtatgcacttttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgacgagcacagcggccctgggctgcctggt

SEQ ID NO: 787364 - DNA, 628 bp, Homo sapiens
  misc_feature: NA.49.27.C05.2.454.heavy.3.multim50
agggtttggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttaatcacggacaacggtgacccccgtccgctcggtgcggaggtcgtgggggccaagggaccacggtcatcgtctcctcagcctccaccaagggcccatcggtcttccccctggcaccctcctccaagagcacctctgggggcacagcggccctgggctgcctggtcaaggactacttcctctctcgact

SEQ ID NO: 787365 - DNA, 489 bp, Homo sapiens
  misc_feature: NA.49.27.C05.4.454.heavy.3.multim50
agggtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaagggcccatcggtcttcccctggcgccctgctccaggagcacctccgagagcacagcggcccgg

SEQ ID NO: 787366 - DNA, 463 bp, Homo sapiens
  misc_feature: NA.48.55.E11.4.454.heavy.3.multim50
ttgggtttggggagctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcggatttcacctacacgc

SEQ ID NO: 787367 - DNA, 496 bp, Homo sapiens
  misc_feature: NA.48.55.E11.5.454.heavy.3.multim50
ttgggtttggggatgcttkskgwkwgksrkggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatcctccgcagacacgtccaagaaccagttctccctgaggckgagctctgtgaccgccgcagacacggctgtctattactgtgcgagaagtgggtcgtggcagtggctggtacgtggctctcagtggttccgacccstggggccaggggataccgtggtcaccgtctcctcagcttccac

SEQ ID NO: 787368 - DNA, 471 bp, Homo sapiens
  misc_feature: NA.48.55.E11.8.454.heavy.3.multim50
ttgggtttgggggagccttggtgcagcctggagagtccctaagactctcctgcgcagcctcaggattcagtttcagtagttatgaaatgaattgggtccgccaggctccagggaagggactggagtggctttcatatattactggcagtgggtctcttacccattatgcagactctgtgaggggccgattcaccatctccagagacaacccccgaaactctctttttctgcaaatggacagcctgacagccgacgatacggccatttattactgtgcgagagatgggacccccgcatatccagaaggcacactctactttgacctctgggggccaggggatcctggtcaccgtctcctcagcctccaccaagggcccatcggtcttcccctggcgccctgctccaggagcacctccgagagcacagcggccctgggctggccctggtcaaggactacttcctatgtatact

SEQ ID NO: 787369 - DNA, 514 bp, Homo sapiens
  misc_feature: NA.48.87.H10.5.454.heavy.3.multim50
ttgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaagggacctcggtcgtccgtttcctcagccctccaccaacggg

SEQ ID NO: 787370 - DNA, 512 bp, Homo sapiens
  misc_feature: NA.51.5.A05.1.454.heavy.3.multim50
agggcacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcacctcgtgtggccccaatttggtttaccggcacacaaaatcagggcaagtcctacgacggtctggtacgtcgs

SEQ ID NO: 787371 - DNA, 464 bp, Homo sapiens
  misc_feature: NA.13.71.G05.3.454.heavy.3.multim50
agcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattagtaatgatggtagctgctactactactttttgacttacgtc

SEQ ID NO: 787372 - DNA, 709 bp, Homo sapiens
  misc_feature: NA.48.35.D02.4.454.heavy.3.multim50
ttgggtttgggcacgaccggtgctcgatttagagagagtgtgttgggtttgggcacgaccggtgctcgatttagagagagtgtgttgggtttgggagctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggaggggatattactttgacaactggggccagggaaccctggtcaccgtctcctcagcctccaccaagggcccatcggtcttccccctggcgccctgctccagsmkcrcctccsagmgsacrgcgrccctgggctgcctggtcaaggactactcctatgta

SEQ ID NO: 787373 - DNA, 578 bp, Homo sapiens
  misc_feature: NA.48.35.D02.9.454.heavy.3.multim50
ttgggtttggggtctgagagaggagcyyrgsyytggggggattttcaggtgttttcatttggtgatcaggactgaacagagagaactcaccatggagtttgggctgagctggctttttctagtgactatttttaaaggtgtccagtgtgaggtgcaactattggagtctgggggtggcctggtgcagccgggggggtccctgagactctcttgtgcagcctctggattcagctttagtaattatgccatgagctgggtccgccaggctccagggaaggggctggagtggatttcatctattagtggtagtggtgttaccacatactacgcagactccgtgaagggccgattcatcatctccagagacagttccaggaacacactggatttgcaaatgaacagcctgagagccgaggacacggccctatattactgtgcgaaatcccatgatagtagttggtttttcttttcgtttctttgaccactgggggccagggatccctgctctacccgtctcctcagcctccaccagggcccatcggtcttcccctggcgccctgcctccaggagcacctccg

SEQ ID NO: 787374 - DNA, 481 bp, Homo sapiens
  misc_feature: NA.52.27.C05.1.454.heavy.3.multim50
agggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtggatggggtggaacaatcccaacagtggaggcaccggtcgcacagaatatgcgcggaagtttcagggcagggtcaccatgaccagcgacaggtccactaacacagcctacatggagctaagtagactgacatctgacgacacggccgtctattattgtgtgagagaggacccgatgacctcgaacatggacgtctggggccacgggkacccg

SEQ ID NO: 787375 - DNA, 482 bp, Homo sapiens
  misc_feature: NA.52.27.C05.4.454.heavy.3.multim50
agggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcaccatcaccagggacacatccgcgagcacagcctacatggagttgagcagcctgagaaatgaagacacggctgtatattactgtgcgagagggggaaatggggtaaggwrttttggagtaagttattatcgtggcggtkgcggacgtckkggggaccgg

SEQ ID NO: 787376 - DNA, 452 bp, Homo sapiens
  misc_feature: NA.49.58.F03.2.454.heavy.3.multim50
aagggaaaggggacccaacaaccacatccctcctcagaagcccccagagcacaacgcctcaccatggactggacctggaggatcctctttttggtggcagcagccacaggtgcccactcccaggtccagcttgtgcagtctggggctgaggcgaagaagcctggggcctcagtgaaggtttcctgccaggcttctggatacaccctcagtacccatgctatccattgggtgcgccaggcccccggacaaagacttgagtggatgggatggatcagcgctggcaatggtgacagacactattcacagaagttccagggcagagtcaccatcaccagggacacatccgcgagcacagcctacatggaactgagcagcctgagatctgaagacaacgggtgtatattactgtgcgagagggaagtgggatatttgtagatgcgccagggtgcccc

SEQ ID NO: 787377 - DNA, 597 bp, Homo sapiens
  misc_feature: NA.49.58.F03.4.454.heavy.3.multim50
aagggaaaggggctgggagaggagcccagcactgggattccgaggtgtttccattcagtgatctgcactgaacacagaggactcgccatggaatttgggctgagctgggttttccttgttgctattataaaaggtgtccagtgtgaggtgcaactggtgcagtctgggggaggcttggtccagcctgggatttccctgagactctcctgtgcagcctctggagtcaccgtcagcaacaactacatgagctgggtccgccaggctcaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 787378 - DNA, 626 bp, Homo sapiens
  misc_feature: NA.49.58.F03.5.454.heavy.3.multim50
aagggaaagggggggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgaacaggctgagagctgaagacacggctttatattactgtgcgaacttaatcacggargacaacggtgaccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctctctcgact

SEQ ID NO: 787379 - DNA, 626 bp, Homo sapiens
  misc_feature: NA.49.72.G06.1.454.heavy.3.multim50
agctctgggagaagagccccagccccagaattcccaggagtttccattcggtgatcagcgctgaacacagaggactcaccatggagtttgggctgagctgggttttccttgttgctattataaaaggtgtcccgtgtcaggtgcagctggtggagtctgggggaggcctggtcaagcctggagggtccctgaagctctcctgtgcagcctctggattcactttcagtgactactacatgaactgggtccgccaggttccagggaaggggctggagtggctttcatatatcagcagtagtggtagcaccatcttctacgcagactctgtgaagggccgattcaccatttcccgggacaacgccaagaagtcactatctctgcacatgatcagcctgagagccgaggacacggccatgtatttctgtgcgagagcccctcacggtggtgggtactgtaccttattacttctacgctatggacgtctggggccaagggaccacggtcaccgtctcctcaccctccaccaagggcccatcggtcttccccctggcaccctcctccaagagcacctctgggggcacagcggccctgggctgcctggtcaaggactacttcctctctcgact

SEQ ID NO: 787380 - DNA, 564 bp, Homo sapiens
  misc_feature: NA.49.72.G06.3.454.heavy.3.multim50
actccaaggcctttccacttggtgatcagcactgagcacagaggactcaccatggagttggggctgagctgggttttccttgttgctattttagaaggtgtccagtgtgaggtgcagctggtggactcggggggaggcttggtccagcctgggggttccctgagactctcctgtgtagtctctggattcagctttaggagttattacatgagttgggtccgccaggctccaggggaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgagagcacagcggccctgggctgcctggtcaaggactacttcctctctcgact

SEQ ID NO: 787381 - DNA, 589 bp, Homo sapiens
  misc_feature: NA.13.23.C01.4.454.heavy.3.multim50
tagggattggggtccttaaattcaggttccagctcacatggaaaatactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactgtagggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggcccatcggtcttccccctggcgccctgctccaggagcacctccgagagcacagcggccctgggctgcctggtcaaggactacttcctagtacgtga

SEQ ID NO: 787382 - DNA, 588 bp, Homo sapiens
  misc_feature: NA.51.37.D04.5.454.heavy.3.multim50
ttgggtttggggagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatctgggggaggcttggtcaagcctggagggtccctgagactctcctgtgcagcctctggattcaccttcagtggctacttcatgagctggatccgccaggctccagggaaggggctgcagtgggtctcacatattagtgctaatgggagaaccacattctacgcagactctgtgaagggccgattctccatctccagggacaacgccaagaactcactgtatctgcaaatgaacagtctaagagccgaagacacggccgtgtacttctgtgcgagtgtgggagaggactacggtgacacggagcctttctcctactacttcggtgtggacgtctggggccaagggaccacggtcaccgtctcctcagcctccaccaacgggcccactcggtccttcccctcggccaccctcctccaagacg

SEQ ID NO: 787383 - DNA, 456 bp, Homo sapiens
  misc_feature: NA.13.67.G01.4.454.heavy.3.multim50
ttgggtctggggggggcttggtccagcctggggggtccctgagactctcctgtgcagcctctggattcacttttagtaggtattggatgggttgggtccgccagactccagagaagggactggagtgggtggccaacataaaggaagatggaagtgaaagatactatgtggactctgtgaagggccgattcaccatctccagagacaacgccaagaactcactgtatctgcagatgaccagcctgagagtcgaggatacggctgtgtattattgtgcgagagatggggcacgacattttgtagaggtgtactgggggccagggagccccggtcaccgtctcctcagcctccaccaagggcccatcggtcttcccctggcgccctgctccaggagcacctccgagagcacagcggccctgggctgcctggtcaaggactacttccgtastacgayga

SEQ ID NO: 787384 - DNA, 627 bp, Homo sapiens
  misc_feature: NA.49.23.C01.1.454.heavy.3.multim50
tagggattggggtctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacagtctgagacgtgaagacacggctgtctattactgtgcgactgagatgtctttacgatgccagtgctttagtaccgttcgacccctggggccagggagccctggtcaccgtctcctcagcttccaccaagggcccatcggtcttcccctggcgccctgctccaggagcacctcgtggggcgacagcggcccgtcgggctgcctggtcaaggactacttcctctctcgact

SEQ ID NO: 787385 - DNA, 507 bp, Homo sapiens
  misc_feature: NA.13.65.F10.2.454.heavy.3.multim50
agggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccagccgggggggtccctgagactctcatgtgcggcctctgggctcaccgtcaacaccaactacatgagctgggtccgccaggctccagggaagaggccggagtgggtctcagttatttatgtcgacggtgccacattctacgcagactccgtgaggggccggttcaccatctccagagacaattccaagaacacggtgtatcttcaaatgaacgacctgagagtcgaggacacggccgtctattactgtgcgaaagatgcagagagggcccccgtaatgggggcctggtggagggttcttcgtttgactgcgtggggccgaggggaaccctcgtcc

SEQ ID NO: 787386 - DNA, 461 bp, Homo sapiens
  misc_feature: NA.49.53.E09.5.454.heavy.3.multim50
ttgggtttggggatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgaacacagcctacatggaactgcgcagcctaggatctgccgacacggccgtatatttctgtgcgagagagatggtctttctatgatagtactagtcatttatgctcg

SEQ ID NO: 787387 - DNA, 545 bp, Homo sapiens
  misc_feature: NA.49.53.E09.6.454.heavy.3.multim50
ttgggtttgggtagttgggtttggggggaagaggaagactgacggtcctcccaggagttcaggtgctgggcaccttgggtttgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggcccagggagccctggtccaccgtctcctcagcttccaccaagggcccatcggtcttccccctggcgccctgctccaggagcacctctgggggcacagcggcccstgggctgcctggtcaaggactacttcctctctcgta

SEQ ID NO: 787388 - DNA, 448 bp, Homo sapiens
  misc_feature: NA.53.78.H01.3.454.heavy.3.multim50
agcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaagggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccaggggacaggggccatcagaacagcctacatgggagctgaacagactgacatctgacgacacggccgttttaattattgtggtgaggagaggacccgagtgaccgtc

SEQ ID NO: 787389 - DNA, 353 bp, Homo sapiens
  misc_feature: NA.13.46.E02.3.454.heavy.3.multim50
ctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 787390 - DNA, 641 bp, Homo sapiens
  misc_feature: NA.52.35.D02.5.454.heavy.3.multim50
ttgggtttggggaggtctcggagaggagccttagccctggactccaaggcctttccacttggtgatcagcactgagcacagaggactcaccatggagttggggctgagctgggttttccttgttgctattttagaaggtgtcttcagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctaccggctgctacttcgatctctggggccgtggcaccctggtcactgtcttctcagcctccaccaagggcccatcggtcttcccctggycaccctcctccaagagcacctctgggggcacgagcggcccgtgggctgcctggtcaaggactacttcctatacg

SEQ ID NO: 787391 - DNA, 471 bp, Homo sapiens
  misc_feature: NA.52.35.D02.8.454.heavy.3.multim50
ttgggtttggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaaggtttgagtggatgggatggatcaccgctggcaatggtgacacaaaatattcacagaagttccagggcagagtcaccattaacagggacacatctgcgagtacaggctacatggaactgagcggcctgagatctgaggacacggctatttattactgtgcgagagggaagtgggatattggtggcargctccaggtcgcccaggccccggrcccccttacg

SEQ ID NO: 787392 - DNA, 467 bp, Homo sapiens
  misc_feature: NA.52.35.D02.11.454.heavy.3.multim50
ttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctcctaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttccccctggcaccctcctccaagagcacctctgggggcacagcggccctgggctgcctggtcaaggactacttcctatacgatcg

SEQ ID NO: 787393 - DNA, 491 bp, Homo sapiens
  misc_feature: NA.51.73.G07.2.454.heavy.3.multim50
agggggctctcagagaggtgccttagccctggattccaaggcatttccacttggtgatcagcactgaacatagaggactcaccatggagttgggactgtgctgggttttccttgttgctattttagaaggtgtccagtgtgaggtgcggctggtggagtctgggggaggcttggtacagcctggggggtccctgacactctcctgtgcagcctctggattccccttcagaacttatgaaatgaactgggtccgacaggctccagggaagggggctggagtgggtttcacacattagtagtgggtggaagtaccatattctacgcagactttgtgcagggccgattcaccatctccagagacgacgccaagaattcactgtatctgaaaatgaacagcctgagagccgacgacacggctgtttattactagtgcgagagtagttactatcatagtagttgggtttttttttcccttacttacyycggttacg

SEQ ID NO: 787394 - DNA, 624 bp, Homo sapiens
  misc_feature: NA.48.29.C07.1.454.heavy.3.multim50
agggaaaggggagctctgggagaggagccccagccctgagaatcccaggtgtttccattcagtgatcagcactgaacacagaggactcaccatggagttgggactgagctggattttccttttgactattttaaaaggtggtcactgtgaacggctactggtggagtctgggggaggcttggtacagcctggcaggtccctgaaactctcctgtgtagcctctggattcaggttgggcgattatgccatgcaatgggtccggcaaggtccagggaagggcctggagtgggtctcaggcatcgattggaaaagcgagaagattgactatgcggagtctgtgaaggggcgattcatcatctccagagacaacgccaagaactccctgtatttgcagatgaacaatctgagacctgacgacacggccttgtattattgtgcaaaagttgtggagtcacagtctctggtactacggtatggacgtctggggccaagggaccacggtcacagtctcctcagcctccaccaasggcccatcggtcttcccctggcaccctcctccaagagcacctctgggggcacgagcggcctgggctgcctggtcaaggactacttcctatgtatact

SEQ ID NO: 787395 - DNA, 465 bp, Homo sapiens
  misc_feature: NA.49.37.D04.8.454.heavy.3.multim50
ttgggtttggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttattactgtgcgaacttaatcacggaggacaagggtaccg

SEQ ID NO: 787396 - DNA, 408 bp, Homo sapiens
  misc_feature: NA.51.73.G07.4.454.heavy.3.multim50
agggcacgaccrgtgctcgatttagtrmgtcagtmagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 787397 - DNA, 467 bp, Homo sapiens
  misc_feature: NA.48.59.F04.3.454.heavy.3.multim50
tagggattggggacccaacaaccacatccctcctcagaagsccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggccccccggacaaaggccttgagtggatggggtggctcaacgctggcgatggtcagacaaagtattcacagaagttccagggcagagtcaccatcaccagggacacgtccgcgagtagtgtcttcatggagctgcgcagtctgagatcgggaagacacgggcagtatattactgtgcgaggaggcggatattgtcgtcgtagggtgacgtgtctacgagtcamaamtcgt

SEQ ID NO: 787398 - DNA, 546 bp, Homo sapiens
  misc_feature: NA.52.55.E11.2.454.heavy.3.multim50
ttgggtttgggggctctgggagaggagcccagcactgggattccgaggtgtttccattcagtgatctgcactgaacacagaggactcgccattgggtttgggcggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttccccctggcaccctcctccaagagcacctctgggggcacagcggccctgggctgcctggtcaaggactacttcctatacgatcg

SEQ ID NO: 787399 - DNA, 507 bp, Homo sapiens
  misc_feature: NA.18.59.F04.1.454.heavy.3.multim50
tagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacactcccctgaaagcgtcaactactactactacggtatggacctcgtggggaccgagggaaccg

SEQ ID NO: 787400 - DNA, 587 bp, Homo sapiens
  misc_feature: NA.49.55.E11.1.454.heavy.3.multim50
ttgggtttgggtttgggagaggagcccagcactgggattccgaggtgtttccattcagtgatctgcactgaacacagaggactcgccatggagtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatagaacagcctgagagccgaggacacggctgtgtattactgtgcgagagatcccccgggtatagcagtgtctggtacatattacgtggggccagkrsaaccctggtcaccggtctcctcagcctccaccaagggcccatcggtcttcccctggccgccctcgctccaggacgcaccctccgagagccacagccggtccc

SEQ ID NO: 787401 - DNA, 480 bp, Homo sapiens
  misc_feature: NA.49.55.E11.4.454.heavy.3.multim50
ttgggtttgggggctctgggagaggagcccagcactagaagtcggcggtgtttccattcggtgatcagcactgaacacagaggactcaccatggagtttgggctgagctgggtttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactggtgtgaaagacttttatgacagtagtggtttctccgagtatgcac

SEQ ID NO: 787402 - DNA, 576 bp, Homo sapiens
  misc_feature: NA.40.38.D05.2.454.heavy.3.multim50
ttgggtttggggatgctttctgagagtcagggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggttggatccgccagcccccagggaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacgggtgccccaagaaaaagtgttttatccctggggccagggaaccctggtcaccgtctcctcagcctccaccaacggcccatcggtcttccccctggcaccctcctccaagagcacctctgggggcacagcggccctgggctgcctggtcaaggactacttccagtcgctaga

SEQ ID NO: 787403 - DNA, 553 bp, Homo sapiens
  misc_feature: NA.48.12.B01.2.454.heavy.3.multim50
tccgcgggcacgaccggtgctcgatttagtagtgtagattccgcgggggctttctgagagtcatggatctcatgtgcaagaaaatgaagcacctgtggttcttcctcctgctggtggcgtctcccagatgggtcctgtcccagctgcacctgcaggagtcgggcccaggactggtgaggccttcggagaccctgtccctcacctgcactgtctctggtgactccatcaacagtggtactttttactactggggctggatccgccagaccccagggaagggtctggagtggattgggagtgtctattctagtgggaacacccactacaatccgtccctcaagagtcgagtcaccatatccgtggacacgtccaagaacgagttctccctgaggttacaatctgtgaccgccgcagacacggctgtatattactgtgcgagacaccggggagggggcttactatggatcggggcgggaggttactactttgactactggggccgaggggagtccgtggtcaccgtctcctcacgcggtacctcccttaccaccgg

SEQ ID NO: 787404 - DNA, 367 bp, Homo sapiens
  misc_feature: NA.49.29.C07.5.454.heavy.3.multim50
agggaaaggggctggagtggctttcatatatcagcagtagtggtagcaccatcttctacgcagactctgtgaagggccgattcaccatttcccgggacaacgccaagaagtcactatctctgcacatgatcagcctgagagccgaggacacggccatgtatttctgtgcgagagcccctcacggtggtgggactgtaccttattacttctacgctatggacgtctggggccaagggaccacggtcaccgtctcctcaccctccaccaagggcccatcggtcttccccctggcaccctcctccaagagcacctctgggggcacagcggccctgggctgcctggtcaaggactacttcctctctcgact

SEQ ID NO: 787405 - DNA, 491 bp, Homo sapiens
  misc_feature: NA.49.29.C07.7.454.heavy.3.multim50
agggaaaggggggctgaactgggttttcctcgttgctcttttaagaggtgtccagtgtcaggtgcagctggtggagtctggggggaggcgtggtccagcctgggaggtccctgagactctcctgttcagcctctggattccccttcaatacctatcctttccactgggtccgccaggctcctggcaaggggctggagtgggtggcagttatatcatatgatggaagccataaaaactacgcagactccgtgacgggccgattcaccatctccagagacaattccagaaacacgctgcatctgcaaatgaacagcctgagacttgaggacacggctgtttattactgtgcgagagatgcgggatattgtggtggtgactgctatcttcccggtgcctactggggccagggaaccctggtcaccgtctcctcggcctccaccaacggsccatcggtccttccccctggccaccctcctccaagacgcacctcc

SEQ ID NO: 787406 - DNA, 619 bp, Homo sapiens
  misc_feature: NA.48.25.C03.1.454.heavy.3.multim50
agctctcagagaggtgccttagccctggattccaaggcatttccacttggtgatcagcactgaacacagaggactcaccatggagctggggctgtgctgggtcttccttgttgcttttttagaaggtgtccagtgtgaggtgcatctggtggagtctgggggagccttggtgcagcctggagagtccctaagactctcctgcgcagcctcaggattcagtttcagtagttatgaaatgaattgggtccgccaggctccagggaagggactggagtggctttcatatattactggcagtgggtctcttacccattatgcagactctgtgaggggccgattcaccatctccagagacaacccccgaaactctctttttctgcaaatggacagcctgacagccgacgatacggccatttattactgtgcgagagatcgggacccccgcatatccagaaggcacactctactttcgacctctggggccaggggatcctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 787407 - DNA, 484 bp, Homo sapiens
  misc_feature: NA.48.25.C03.3.454.heavy.3.multim50
atgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaagggacctcggtccgccgtttt

SEQ ID NO: 787408 - DNA, 474 bp, Homo sapiens
  misc_feature: NA.48.25.C03.6.454.heavy.3.multim50
cytttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccacgcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagccgcagtggyyttttgatkkccgtttagwmtatkgtcggggwccrargggacgaagtcggtmcgwmccgkycttccg

SEQ ID NO: 787409 - DNA, 466 bp, Homo sapiens
  misc_feature: NA.52.38.D05.2.454.heavy.3.multim50
ttgggtttgggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcacttatatcctatgatggaagcaataagcactacgcagagtccgtgaagggccgattgaccatctccagagacaactcgaagaatacggttcttctacaaatgaacagcctgagagctgaggacacggctattcttttactgtgcgagagggaactcgattacagcacgcccg

SEQ ID NO: 787410 - DNA, 465 bp, Homo sapiens
  misc_feature: NA.52.38.D05.4.454.heavy.3.multim50
ttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctggtcaaggactacttcctatacgatcg

SEQ ID NO: 787411 - DNA, 476 bp, Homo sapiens
  misc_feature: NA.52.38.D05.6.454.heavy.3.multim50
ttgggtttgggtctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtctgggggaggcttggtacagcctggggggtccctgagactctcctgtgcagcctctggatccacctttagtaactatgccatgagttgggtccgccaggctccaggggaggggctggagtgggtctcagcgattagtgctagtggtggtagcacattctacggagactccgtgaagggccggttcaccatctccagagacaattccaagaacacgctgtttctgcaagtgaacagcctgagagccgatgacacggccgtatagttactgcgacgaaacgatctgccacagtgcaacggtcccctccattttac

SEQ ID NO: 787412 - DNA, 616 bp, Homo sapiens
  misc_feature: NA.52.37.D04.4.454.heavy.3.multim50
ttgggtttggggagctctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtkgrgtytgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccaggggggcgggagcagccccgtaacttcgtggggccagggaacccgggtcaccgtctcctcagcctccaccaagggcccatcggtcttcccctggcaccctcctccaagagcacctctgggggcacagcggccctgggctgcctggtcaaggactacttcctatacgatcg

SEQ ID NO: 787413 - DNA, 474 bp, Homo sapiens
  misc_feature: NA.52.37.D04.6.454.heavy.3.multim50
ttgggtttggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaaggtttgagtggatgggatggatcaccgctggcaatggtgacacaaaatattcacagaagttccagggcagagtcaccattaacagggacacatctgcgagtacaggctacatggaactgagcggcctgagatctgaggacgacggtctatttattactgtgtcgagrrggaagtggggatattgtggcagctccgagggtcgcccgagcccggccccyttaccg

SEQ ID NO: 787414 - DNA, 478 bp, Homo sapiens
  misc_feature: NA.52.37.D04.9.454.heavy.3.multim50
ttkggtttggggtgctcgatttagtgtgagtagtttgggtttgggctcaactctcttgtccaccttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtgggcaccctggtcactgtcttctcagcctccaccaagggcccatcggtcttccccctggccaccctcctccaagagcacctctc

SEQ ID NO: 787415 - DNA, 499 bp, Homo sapiens
  misc_feature: NA.51.34.D01.2.454.heavy.3.multim50
ttgggtttggggctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggcttctttttactgtgcgccaggaagcagtggctggccacatcatgtcttttgtattatctggagccaagggacaatggtct

SEQ ID NO: 787416 - DNA, 370 bp, Homo sapiens
  misc_feature: NA.49.14.B03.1.454.heavy.3.multim50
tycgcgggcacgaccggtgctcgatttagtgtrstrygaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 787417 - DNA, 452 bp, Homo sapiens
  misc_feature: NA.48.38.D05.3.454.heavy.3.multim50
ttgggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagatagtactaa

SEQ ID NO: 787418 - DNA, 603 bp, Homo sapiens
  misc_feature: NA.52.68.G02.1.454.heavy.3.multim50
agctctgggagacgagcccagcactggaagtcgccggtgtttccattcggtgatcatcactgaacacagaggactcaccatggaatttgggctgacttgggttttcctcgttgctcttttaagaggtgtccagtgtcaggtgcaactggtggagtctgggggaggcgtggtccagcctgggaggtccctgagactctcctgtgtcgcctctggattcaccttcagtatttatggcatttattgggtccgtcaggctccaggcaaggggctggaatgggtggcctttatttcatatgatggaaccaataaagcctacactgactccgtgaagggccgattcaccatctcccgagacaattccaagaacacactctatctgcaaatgaacagcctgagacatgaggacacggctgtttactcttgtgcgagaattgccctcgtttagggggccctttgacaactggggccagggaaccckcgtcaccgtctcctcagcctccaccaagggcccatcggtcttcccctggcaccctcctccaagagcacctctgggggcacagcggccctgggctgcctggtcaaggactacttcctatacgatcg

SEQ ID NO: 787419 - DNA, 479 bp, Homo sapiens
  misc_feature: NA.52.58.F03.1.454.heavy.3.multim50
aagggaaagggggagagaggagccttagccctggattccaaggcctatccacttggtgatcagcactgagcaccgaggattcaccatggaattggggctccgctgggttttccttgttgctattttagaaggtgtccagtgtgaggtgcagctggtggagtctgggggaggcctggtcaagccgggggggtccctgagactctcctgtgcagcctctggattcaccttcagcagttatagcatgaactgggtccgccaggctccgagggaaggggctggagtgggtctcatttattagtactagttacttatactacgcagactcagtgaagggccgattcaccatctccagagacaacgccaggaattcactatatttgcaaatagaacagcctgcgagccgaggacacggcgtgtgtattactgtgcgcgagaacacagcaatggccatttcgactacgtggggccagggtaacccg

SEQ ID NO: 787420 - DNA, 600 bp, Homo sapiens
  misc_feature: NA.49.68.G02.1.454.heavy.3.multim50
acccaacaaccacatccctcctcagaagcccccagagcacaacgcctcaccatggactggacctggaggatcctctttttggtggcagcagccacaggtgcccactcccaggtccagcttgtgcagtctggggctgaggcgaagaagcctggggcctcagtgaaggtttcctgccaggcttctggatacaccctcagtacccatgctatccattgggtgcgccaggcccccggacaaagacttgagtggatgggatggatcagcgctggcaatggtgacagacactattcacagaagttccagggcagagtcaccatcaccagggacacatccgcgagcacagcctacatggaactgagcagcctgagatctgaagacacgggtgtatattactgtgcgagagggaagtgggatattgtagatgcgccagggtgcccgggccccctactttgactactggggccggggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 787421 - DNA, 553 bp, Homo sapiens
  misc_feature: NA.49.68.G02.3.454.heavy.3.multim50
acctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagcccccagggaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 787422 - DNA, 422 bp, Homo sapiens
  misc_feature: NA.49.82.H05.2.454.heavy.3.multim50
cacgaccggtgctcgatttagtcgagctctctcgcgggcacgaccggtgctcgatttagactcatctacagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctcccaagagcacctctgggggcacagcggccctgggctgcctggtcaaggactacttcctctctcgact

SEQ ID NO: 787423 - DNA, 484 bp, Homo sapiens
  misc_feature: NA.49.82.H05.4.454.heavy.3.multim50
cacgaccggtgctcgatttagatcgtctgtgttgggtttgggggatttgggggcaatttatgaacccgaaaggacatggccatggggtgggtagggacagtagggacagatgtcagcctgaggtgaagcctcaggacacaggtgggcatggacagtgtccacctaagcgagggacagacccgagtgtccctgcagtagacctgagagcgctgggcccacagcctcccctcggggccctgctgcctcctcaggtcagccctggacatcccggctttccccaggcctggcggtaggtttgaagtgaggtctgtgtcactgtggtcttactatgatagtagtggttatattagcagccacttccagcacattcggctactggggccagggaaccctggtcaccgtctcctcagcctccaccaagggcccatcggtcttccccctggccaccctcctccaagagcacctctgggggcacagcggccct

SEQ ID NO: 787424 - DNA, 445 bp, Homo sapiens
  misc_feature: NA.49.45.E01.3.454.heavy.3.multim50
tctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcacttatatcctatgatggaagcaataagcactacgcagagtccgtgaagggccgattgaccatctccagagacaactcgaagaatacggttcttctacaaatgaacagcctgagagctgaggacacggctatcttttactgtgcgagagggaactcgattacagcag

SEQ ID NO: 787425 - DNA, 577 bp, Homo sapiens
  misc_feature: NA.49.45.E01.5.454.heavy.3.multim50
atgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcaggtagtaattactactggggctgggtccgccagcccccagggaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtaggacgtcgtgggscsaagggaccacggtcaccgtctcctcacgcctccaccaagggcccatcggtcttccccctggcaccctcctccaagagcacctctgggggcacagcggccctgggctgcctggtcaaggactacttcctctctcgact

SEQ ID NO: 787426 - DNA, 575 bp, Homo sapiens
  misc_feature: NA.51.27.C05.2.454.heavy.3.multim50
agggtttggggggggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtcgtggggccaaggggaccacggtcaccgtctccttagcctccaccaacgggcccatcggtcttccccctggccaccctcctccaagagcacctcgtc

SEQ ID NO: 787427 - DNA, 632 bp, Homo sapiens
  misc_feature: NA.49.35.D02.1.454.heavy.3.multim50
ttgggtttggggtctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggccccatccggtctttccccctggccgccctcgctccaaggagcgacctctgggggcacagcggccctgggctgcctggtcaaggactacttcctctctcga

SEQ ID NO: 787428 - DNA, 627 bp, Homo sapiens
  misc_feature: NA.52.53.E09.1.454.heavy.3.multim50
ttgggtttggggagctctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttcccctggcaccctcctccaagagcacctctgggggcacagcggccctgggctgcctggtcaaggactacttcctatacgatcgggacctttacccg

SEQ ID NO: 787429 - DNA, 630 bp, Homo sapiens
  misc_feature: NA.48.70.G04.1.454.heavy.3.multim50
  modified_base (618)..(618): a, c, t, g, unknown or other
cagctctgggagaggagccccagccttggaattcccaagtgttttcattcagtgatcaggactgaacacagaggactcaccatggagtttgggctgagctggattttccttgctgctattttaaaaggtgtccagtgtgaggtgcagctggtgcagtccggggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttccccctggcgccctgctccaggagcacctccgagagcacagcggccctgggctgcctggtcaaggactacttcctatgtatactstgcggcggngtcgacgacggc

SEQ ID NO: 787430 - DNA, 475 bp, Homo sapiens
  misc_feature: NA.13.39.D06.1.454.heavy.3.multim50
cagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggcccatccgttcccg

SEQ ID NO: 787431 - DNA, 519 bp, Homo sapiens
  misc_feature: NA.49.12.B01.5.454.heavy.3.multim50
tccgcgggcacgaccggtgctcgatttagcagtactgcgttgggtttgggggakscgyggkcmmgmctsggwgstcgmytkagactmkctctgygtwgkstytggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccactcggtcttcccctggcaccctcctccaagagcacctctgggggcacacgcggcccgtgggcctgcctggtcgaaggtactacttcctctctcgacct

SEQ ID NO: 787432 - DNA, 469 bp, Homo sapiens
  misc_feature: NA.53.35.D02.2.454.heavy.3.multim50
tttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaagggcccatcggtcttcccctggcgtcccg

SEQ ID NO: 787433 - DNA, 583 bp, Homo sapiens
  misc_feature: NA.49.41.D08.5.454.heavy.3.multim50
ctgggagaggagcccagcactgggattccgaggtgtttccattcagtgatctgcactgaacacagaggactcgccatggaatttgggctgagctgggttttccttgttgctattataaaaggtgtccagtgtgaggtgcaactggtgcagtctgggggaggcttggtccagcctgggatttccctgagactctcctgtgcagcctctggagtcaccgtcagcaacaactacatgagctgggtccgccaggctccaggaaagggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 787434 - DNA, 542 bp, Homo sapiens
  misc_feature: NA.49.34.D01.3.454.heavy.3.multim50
ttgggtttgggctgagcttgggttttcctcgttgctcttttaagaggtgtccagtgtcaggtgcagctggttgggtttgggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 787435 - DNA, 589 bp, Homo sapiens
  misc_feature: NA.9.30.C08.1.454.heavy.3.multim50
aagggaaagggtctgtgaaggcttcaccagtcctggacctcctgtgcaagaacatgaaacacctgtggttcttcctcctgctggtggcagctcccagatgggtcctgtcccaggtgcagctgcaggagaagggaaagggtctggtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 787436 - DNA, 426 bp, Homo sapiens; identical to SEQ ID NO: 786133
  misc_feature: NA.48.9.A09.3.454.heavy.3.multim50

SEQ ID NO: 787437 - DNA, 470 bp, Homo sapiens
  misc_feature: NA.49.10.A10.2.454.heavy.3.multim50
agggtcttcgtggctcacgtccaccaccacgcatgtgacctcaggggtccgggagatcatgagggtgtccttgggttttggggggaagaggaagactgacggtccccccaggagttcaggtgctgggcacggtgggcattggtgactcatgtggaagacagaaaattgtacgcagactccgtgaggggccgattcatcatctccaaagactactccaagaatacggtgtatcttcaaatgaatggcctcgtttttgcggacacggctgtttattattgtgcgacagggggccccccctttcaggagcgatcatactactttgaccactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 787438 - DNA, 640 bp, Homo sapiens
  misc_feature: NA.52.27.C05.3.454.heavy.3.multim50
agggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttcccctggcaccctcctccaagagcacctctgggggcacagcggccctgggctgcctggtcaaggactacttcctatacgatcg

SEQ ID NO: 787439 - DNA, 644 bp, Homo sapiens
  misc_feature: NA.52.38.D05.3.454.heavy.3.multim50
ttgggtttggggaggtctcggagaggagccttagccctggactccaaggcctttccacttggtgatcagcactgagcacagaggactcaccatggagttggggctgagctgggttttccttgttgckrtttkrgacmggtgctcgattcagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttcccctggcaccctcctccaagagcacctctgggggcacgagcggccctgggctgcctggtcaaggactacttcctatacg

SEQ ID NO: 787440 - DNA, 485 bp, Homo sapiens
  misc_feature: NA.48.15.B04.5.454.heavy.3.multim50
tccgcgggcacgaccggtgctcgatttagatmgctctgygttgggtgcagttggtggaktyrgrkgkmkgtgttggkyywgcskgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggcgccctgctccacggagcacctccgagacgcacagcc

SEQ ID NO: 787441 - DNA, 555 bp, Homo sapiens
  misc_feature: NA.49.28.C06.5.454.heavy.3.multim50
agaggagcccagcactgggattccgaggtgtttccattcagtgatctgcactgaacacagaggactcgccatggagtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaagggcccatcggtcttcccctggcgccctgctccaggagcacctccgagagcacagcc

SEQ ID NO: 787442 - DNA, 478 bp, Homo sapiens
  misc_feature: NA.49.87.H10.1.454.heavy.3.multim50
ttgggtttggggttgaagtgaagaagcctggggcctcggtgaaggtttcctgcaaggcatctggatacagcttgaccaactactatatacagtgggtgcgacaggcccctggacaagggcttgagtggatgggaagaatcaaccctaatgatggaagtacaacaaacgcgcagaaatttcagggcagaataaccctgaccagggacacgtccacgagcacagtctacatggaattgagcagcctgagatctgaagacacggccgtctattactgtgccagagaatatcgttttatagtgggagctgccccacgatcgccattccactttgactactggggccagggaacactggtcaccgtctcctcagcctccaccaagggcccatcggtcttccccctggcaccctcctccaagagcacctctgggggcacagcggccctgggctgcctggtcaaggactacttcctctctcgact

SEQ ID NO: 787443 - DNA, 626 bp, Homo sapiens
  misc_feature: NA.48.30.C08.2.454.heavy.3.multim50
aagggaaaggggagctctgggagaggagccccagccctgagaatcccaggtgtttccattcagtgatcagcactgaacacagaggactcaccatggagttgggactgagctggattttccttttgactattttaaaaggtggtcactgtgaacggctacaagggaaaggggggggaggcttggtacagcctggcaggtccctgaaactctcctgtgtagcctctggattcaggttgggcgattatgccatgcaatgggtccggcaaggtccagggaagggcctggagtgggtctcaggcatcgattggaaaagcgagaagattgactatgcggagtctgtgaaggggcgattcatcatctccagagacaacgccaagaactccctgtatttgcagatgaacaatctgagacctgacgacacggccttgtattattgtgcaaaagttgtggagtcacagtctctggactacggtatggacgtctggggccaagggaccacggtcacagtctcctcagcctccaccaagggcccatcggtcttccccctggccaccctcctccaagagcacctctgggggcacagcggccctgggctgcctggtcaaggactacttcctatgtatact

SEQ ID NO: 787444 - DNA, 630 bp, Homo sapiens
  misc_feature: NA.49.79.H02.1.454.heavy.3.multim50
agggaaagggggctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgaacaggctgagagctgaagacacggctttatattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctggggcacagcggccctgggctgcctggtcaaggactacttcctctctcgact

SEQ ID NO: 787445 - DNA, 473 bp, Homo sapiens
  misc_feature: NA.49.86.H09.8.454.heavy.3.multim50
ttgggtttgggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccyyggcaccctcctccaagagacacctctgggggcacagcggccctgggctgcctggtcaaggactacttcctctctcgact

SEQ ID NO: 787446 - DNA, 628 bp, Homo sapiens
  misc_feature: NA.51.30.C08.1.454.heavy.3.multim50
aaagggaaaggggtctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggagtgggtggcacttatctcatctgatggaaggtctgaatcttatgccgactccgtgaagggccgattcaccatctccagagacaattccaagaatacactatatcttcaaatgaacagtctgagacgtgaagacacggctgtctattactgtgcgactgagatgtcttattacgatgccagtggtttagtaccgttcgacccctggggccagggaaccctggtcaccgtctcctcagcttccaccaagggcccatcggtcttccccctggcgccctgctccaggagcacctctgggggcacagcggccctgggctgcctggtcaaggactacttcctcgtagcact

SEQ ID NO: 787447 - DNA, 626 bp, Homo sapiens
  misc_feature: NA.13.10.A10.1.454.heavy.3.multim50
aggggtccgggagctctgggagaggagacccagccttttgattcccaagtgttgtcattcagtgatcaggactgggcacagaggactcaccatggagtttgggctgaggtggtttttccttggtgctattttaaaaggtgtccattgtgaagggtcttcgtggctcacgtccaccaccacgcatgtgacctcagggagtccctgagactctcctgtgaagcctcaacattcacttttgctcgtgcctgggtgacctgggtccgccaggctccagggaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaaccctggtcaccgtctcctcagcctccaccaagggcccatcggtcttccccctggcaccctcctccaagagcacctctgggggcacagcggccctgggctgcctggtcaaggactacttccg

SEQ ID NO: 787448 - DNA, 609 bp, Homo sapiens
  misc_feature: NA.52.87.H10.4.454.heavy.3.multim50
ttgggtttgggggggagaggagcccagcactgggattccgaggtgtttccattcagtgatctgcactgaacacagaggactcgccatggagtttgggctgagctgggttttccttgttgctattttaaaaggtgtccagtgtggagtgcaggtggttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttcccctcggcaccctcctccaagagcacctctgggggcacagcggccctgggctgcctggtcaaggactacttcctatacgatcg

SEQ ID NO: 787449 - DNA, 626 bp, Homo sapiens
  misc_feature: NA.48.53.E09.2.454.heavy.3.multim50
ttgggtttggggckgggagacgagcccagcactggaagtcgccggtgtttccattcggtgctcagcactgaacacagaggactcaccatggagtttgggctgaactgggttttcctcgttgctcttttaagagatgtccagtgtygggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactactttcctatgtatact

SEQ ID NO: 787450 - DNA, 632 bp, Homo sapiens
  misc_feature: NA.48.28.C06.4.454.heavy.3.multim50
tctgtgttgggttctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatccggtcttccccctggccgccctcgcctccaggagcacctcccgagagcacagcggccctgggctgcctggtcaaggactacttcctatgtata

SEQ ID NO: 787451 - DNA, 514 bp, Homo sapiens
  misc_feature: NA.18.14.B03.1.454.heavy.3.multim50
ttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacatttgggggagttatcgcgaaacgggggggtactactacgctatggacgtctggggccaagggaccacggtcaccgtctcctcagcctccaccaagggcccatcggtcttcccctggccaccctcctccaagagcacctctgggggcacgcg

SEQ ID NO: 787452 - DNA, 484 bp, Homo sapiens
  misc_feature: NA.49.57.F02.2.454.heavy.3.multim50
ttgggtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaagggcccatcggtcttcccctggcgccctgctccaggagcacctccgagagcacagcc

SEQ ID NO: 787453 - DNA, 473 bp, Homo sapiens
  misc_feature: NA.48.14.B03.3.454.heavy.3.multim50
tccgcgggcacgaccggtgctcgatttagatcgtctgtgttgggaggtgtggtccagcctgggaagtccctgacactgtcctgcgcagcctctggatttcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggcccgtgggctcgg

SEQ ID NO: 787454 - DNA, 492 bp, Homo sapiens
  misc_feature: NA.51.35.D02.4.454.heavy.3.multim50
ttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatcggtcttccccctcggcaccctcctccaagagcacctcg

SEQ ID NO: 787455 - DNA, 641 bp, Homo sapiens
  misc_feature: NA.52.33.C11.5.454.heavy.3.multim50
ttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttcccctggcaccctcctccaagagcacctctgggggcacagcggccctgggctgcctggtcaaggactacttcctatacgatcg

SEQ ID NO: 787456 - DNA, 667 bp, Homo sapiens
  misc_feature: NA.48.55.E11.1.454.heavy.3.multim50
ttgggtttgggcacgaccggtgytsgrtttgrgrtctgtgttgggtttggggctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 787457 - DNA, 536 bp, Homo sapiens
  misc_feature: NA.48.87.H10.2.454.heavy.3.multim50
ttgggtttgggctgaactgggttttcctcgttgctcttttaagagatgtccagtgttgggtttggggatttagatgtctgtgttgggtttgggggggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggccgccctgctccaggagcacctccgagagcacagcggccctsgggctgcctggtcaaggactacttcctatgtatack

SEQ ID NO: 787458 - DNA, 491 bp, Homo sapiens
  misc_feature: NA.48.35.D02.1.454.heavy.3.multim50
ttgggtttggggagtgactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgtacacacaccatcttgacgactggggatgcttttcatttctggggccaggggaccgtggtcgccgtgtctacagcctccaccaagggcccatcggtcttcccctsgccaccc

SEQ ID NO: 787459 - DNA, 571 bp, Homo sapiens
  misc_feature: NA.51.37.D04.2.454.heavy.3.multim50
ttgggtttggggtctgggagacgagcccagcactggaagtcgccggtgtttccattcggtgatcatcactgaacacagacattgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatcggtcttcccctggccaccctcctccaagagcacctc

SEQ ID NO: 787460 - DNA, 481 bp, Homo sapiens
  misc_feature: NA.48.73.G07.2.454.heavy.3.multim50
agggcacgaccggtgctcgatttagatcgtctgtgttgggtttgggtggaggtgtggtccagcctgggaagtccctgacactgtcctgcgcagcctctggattcaccttcaccaccttttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggccgccctgctccaggagcacctccgagagcacagcggcccgtgggctgyck

SEQ ID NO: 787461 - DNA, 524 bp, Homo sapiens
  misc_feature: NA.12.33.C11.1.454.heavy.3.multim50
ttgggtttggggggaagaggaagactgacggtccccccaggagttcaggtgctgggcacgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacagcggccctgggctgcctggtcaaggactacttcctacgtcgtat

SEQ ID NO: 787462 - DNA, 620 bp, Homo sapiens
  misc_feature: NA.49.37.D04.4.454.heavy.3.multim50
ttgggtttgggggcatcatccaacaaccacatcccttctctacagaagcctctgagaggaaagttcttcaccatggactggacctggagggtcttctgcttgctggctgtagctccaggtgctcactcccaggtgcaactggttgggtttggggttgaagtgaagaagcctggggcctcggtgaaggtttcctgcaaggcatctggatacagcttgaccaactactatatacagtgggtgcgacaggcccctggacaagggcttgagtggatgggaagaatcaaccctaatgatggaagtacaacaaacgcgcagaaatttcagggcagaataaccctgaccagggacacgtccacgagcacagtctacatggaattgagcagcctgagatctgaagacacggccgtctattactgtgccagagaatatcgttttatagtgggagctgccccacgatcgccattccactttgactactggggccagggaacactggtcaccgtctcctcagcctccaccaagggcccatcggtcttcccctggccaccctcctccaagagcacctctgggggcacagcggccctgggctgcctggtcaaggactacttcctctctcgact

SEQ ID NO: 787463 - DNA, 468 bp, Homo sapiens; identical to SEQ ID NO: 787339
  misc_feature: NA.49.77.G11.1.454.heavy.3.multim50

SEQ ID NO: 787464 - DNA, 571 bp, Homo sapiens
  misc_feature: NA.51.34.D01.3.454.heavy.3.multim50
ttgggtttggggtctgggagacgagcccagcactggaagtcgccggtgtttccattcggtgatcatcactgaacacagacattgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatcggtcttcccctggcaccctcctccaagagcacctcg

SEQ ID NO: 787465 - DNA, 629 bp, Homo sapiens
  misc_feature: NA.48.38.D05.1.454.heavy.3.multim50
ttgggtttggggagctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 787466 - DNA, 626 bp, Homo sapiens
  misc_feature: NA.52.34.D01.1.454.heavy.3.multim50
ttgggtttgggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcaactgttggagtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttccccctggcaccctcctccaagagcacctctgggggcacagcggccctgggctgcctggtcaaggactacttcctatacgatcg

SEQ ID NO: 787467 - DNA, 320 bp, Homo sapiens
  misc_feature: NA.49.45.E01.2.454.heavy.3.multim50
ctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 787468 - DNA, 344 bp, Homo sapiens
  misc_feature: NA.13.46.E02.1.454.heavy.3.multim50
ctggagtggattggccgtattaaaagtgagcctgatggtgggacaacagactacgctgcacccgtgaagggcagattcaccatctccagagatgattcaaggaacacagtgtttctgcaaatgaacagcctgactgccggggacactgccgtgtattactgtgccagcagcagtacctggccactatatttttttgacttctggggccagggaaccctggccaccgtctcctcagcttccaccaagggcccatcggtcttccccctggcgccctgctccaggagcacctctgggggcacagcggccctgggctgcctggtcaaggactacttcctagtacgtga

SEQ ID NO: 787469 - DNA, 389 bp, Homo sapiens; identical to SEQ ID NO: 786569
  misc_feature: NA.40.38.D05.3.454.heavy.3.multim50

SEQ ID NO: 787470 - DNA, 320 bp, Homo sapiens; identical to SEQ ID NO: 787467
  misc_feature: NA.49.69.G03.1.454.heavy.3.multim50

SEQ ID NO: 787471 - DNA, 585 bp, Homo sapiens
  misc_feature: NA.49.29.C07.2.454.heavy.3.multim50
agggaaaggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagcccccagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 787472 - DNA, 446 bp, Homo sapiens
  misc_feature: NA.15.70.G04.1.454.heavy.3.urt
aagaccgatgggcccttggtgaagccttcggagaccctgtccctcacctgcactgtctctggtgactccatcagtccttactactggacctggatccggcagcccccagggaagggactggagtggattggatatatctattacagtgggggcaccaactacaacccctccctcaagagtcgagtcatcatttcagtagacacgtccaagaaccagttctccctgaagatgagctctgtgaccgccgctgacacggccgtctattattgtgcgagacatcggcacctaagttggttcgacccctggggccagggaacccgggtcaccgtcgcctcagcctccaccaagggcccatcggtcttccccctggcaccctcctccaagagcacctctgggggcacagcggccctgggctgcctggtcaaggactacttccgctacgtaga

SEQ ID NO: 787473 - DNA, 449 bp, Homo sapiens
  misc_feature: NA.22.70.G04.1.454.heavy.3.urt
cctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggtaccagctgttaaaaactcctactacggtctggacg

SEQ ID NO: 787474 - DNA, 474 bp, Homo sapiens
  misc_feature: NA.48.5.A05.1.454.light.4.nb
agggcacgaccggtgctcgatttagatagatagacaggggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccaaggtggaaatcaaacgaactgtggctgcaccatct

SEQ ID NO: 787475 - DNA, 445 bp, Homo sapiens
  misc_feature: NA.12.33.C11.1.454.light.4.nb
ttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgcaacttattattgtcaacaaagttatgagacccctgccactttcggccctgggaccatagtggatatgaaacgaactgtggctgcacc

SEQ ID NO: 787476 - DNA, 434 bp, Homo sapiens
  misc_feature: NA.4.54.E10.1.454.light.4.nb
aacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctactttttttaagttggtatcagcagacaccagggaaagcccctaagctcctgatctatgctgcttccagtttgcaaagtggggtcccatcaaggttcagtggcagtggatctgggacagatttcactctcactgtcagcagtctgcaatttgaagtattttgctaacttactactgtcaacagagtttcagtatcccttggactttcggccaagggaccaaggtggaaatcaaacgaa

SEQ ID NO: 787477 - DNA, 497 bp, Homo sapiens
  misc_feature: NA.48.7.A07.1.454.light.4.nb
aagctcagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagagtcaccatctcctgttctggaagcagcgccaacattggacgtaatactgtcaactggtaccaacaactcgcaggaacggcccccaaactcctcatctatgaccatcataagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcagcccaaggctgccccctcggtcactctgttcccaccctcctctatgtatact

SEQ ID NO: 787478 - DNA, 460 bp, Homo sapiens
  misc_feature: NA.51.28.C06.1.454.light.4.nb
tggaagaacctgcccagcctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagcccaaggctgccccctcggtctacc

SEQ ID NO: 787479 - DNA, 321 bp, Homo sapiens
  misc_feature: NA.3.57.F02.1.454.light.4.nb
ttgggtttggggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggtcttcggcggcgggaccaagctgaccgtcctatgtcaacccaaggctggcccctcggtcactctgttcccaccctcctcgagtgcgtct

SEQ ID NO: 787480 - DNA, 451 bp, Homo sapiens
  misc_feature: NA.10.53.E09.1.454.light.4.nb
ttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaaacgaactgtgg

SEQ ID NO: 787481 - DNA, 462 bp, Homo sapiens
  misc_feature: NA.4.37.D04.1.454.light.4.nb
ttgggtttgggggctttgcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcaggggtttctaatcgcttctctggttacaagtctggcaacacggcctccctgaccatctctgggctccaggctgaggacgaggctgattattactgcagctcatatacaagcagcagcactggggtcttcggaactgggaccaaggtcaccgtcgtcccacgtcagcccaaggccaaccccactgtcactctgttcccaccctcctcctacagtg

SEQ ID NO: 787482 - DNA, 450 bp, Homo sapiens
  misc_feature: NA.53.34.D01.1.454.light.4.nb
ttgggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggaggataaatatacttgctggtatcagcagaagccaggccagtcccctgtgttggtcatctatcaagataggaagcggccctcagggatccctgagcgattctctggctccaactctgggaacacagccactctgaccatcagcgggacccaggctatggatgaggctgactattattgtcaggcgtgggacagcaaccctgattgggtgttcggcggagggaccaaactgaccgtcctaggtcagcccaaggctgccccctc

SEQ ID NO: 787483 - DNA, 476 bp, Homo sapiens
  misc_feature: NA.22.36.D03.1.454.light.4.nb
atctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcactcttcg

SEQ ID NO: 787484 - DNA, 486 bp, Homo sapiens
  misc_feature: NA.11.58.F03.1.454.light.4.nb
aagggaaagggggggaagcctgagaacacttagccttcatgagtgtccccaccatggcctggatgatgcttctcctcggactccttgcttatgggtcaggagtggattctcaggctttggtgacccaggagccatcgttctcagtgtcccctggagggacactcacactcacttgtggcttgagatacgggtcagtctctgttaattactaccccagttggtaccgacagaccccaggccagcctccacgcacgctcatttataacacaaagactcgctcttctggggtccctaatcgcttctctggctccatccttgggaacaaagctgccctcaccatcacgggggcccaggcggacgatgaatctatttattattgtgtactttttgtgggtcgtggcatttctgctgtgttcggcggaggcacccaggtgaccgtcctcggtcagcccaaggctgccccatcggtcactctgttcccaccct

SEQ ID NO: 787485 - DNA, 465 bp, Homo sapiens
  misc_feature: NA.17.25.C03.1.454.light.4.nb
agtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatctgtcttcatcttcccgccatctgactagtctacg

SEQ ID NO: 787486 - DNA, 444 bp, Homo sapiens
  misc_feature: NA.52.5.A05.1.454.light.4.nb
aggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcggagggaccaagctgaccgtcctacgtcagcccaaggctgccccctcggtc

SEQ ID NO: 787487 - DNA, 488 bp, Homo sapiens
  misc_feature: NA.3.78.H01.1.454.light.4.nb
cacgaccggtgctcgatttagtgtgagtagtttgggtttggggaggaactgctcagttaggacccagagggaaccatggaagccccagcccagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagatttcgcagtttattactgtcagcagcgtagcaactggctgatcaccttcggccaagggacacgactggagattaaacgaactgtggctgcaccatctgtcttcatctt

SEQ ID NO: 787488 - DNA, 444 bp, Homo sapiens
  misc_feature: NA.41.39.D06.1.454.light.4.nb
cagttctttggggagagaagagctgctcagttaggacccagagggaaccatggaaaccccagcgcagcttctcttcctcctgctactctggctcccagataccaccgaagaaattgtgttgacgcagtctccaggcaccctgtctttgtctccaggagaaagagccaccctctcctgtagggccagtcagattgttagcagcggctacttagcctggttccagcagagacctggccaggctcccaggctcctcatctatgaagcgtccatcaggcccactggcatcccagacagattcagtggcagtgggtctgggacagacttcactctcaccatcagcggactggagcctgaagattttgcagtctattactgtcagcagtatggtggctcacctccgtacacctttggccaggggaccaagctggagatcaaacgaactgt

SEQ ID NO: 787489 - DNA, 477 bp, Homo sapiens
  misc_feature: NA.7.86.H09.1.454.light.4.nb
ttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttccccg

SEQ ID NO: 787490 - DNA, 434 bp, Homo sapiens
  misc_feature: NA.19.21.B10.1.454.light.4.nb
agagaggaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtgg

SEQ ID NO: 787491 - DNA, 472 bp, Homo sapiens
  misc_feature: NA.17.62.F07.1.454.light.4.nb
aagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcctagtctacg

SEQ ID NO: 787492 - DNA, 450 bp, Homo sapiens
  misc_feature: NA.46.35.D02.1.454.light.4.nb
ttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccatctgtt

SEQ ID NO: 787493 - DNA, 496 bp, Homo sapiens
  misc_feature: NA.40.71.G05.1.454.light.4.nb
cacgaccggtgctcgatttagtgtcgtcgcaagagagagggggaagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggatagcggcctgagtgatgagtggatgttcggcggcgggaccaaactgaccgtcctaggtcagcccg

SEQ ID NO: 787494 - DNA, 453 bp, Homo sapiens
  misc_feature: NA.16.53.E09.1.454.light.4.nb
ttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactgtggc

SEQ ID NO: 787495 - DNA, 422 bp, Homo sapiens
  misc_feature: NA.49.76.G10.1.454.light.4.nb
aggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaactgtgg

SEQ ID NO: 787496 - DNA, 471 bp, Homo sapiens
  misc_feature: NA.9.43.D10.1.454.light.4.nb
aggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtggttatgactatgtctcctggtatcaacaacacccaggcaaagcccccaaactcttgatttatgaggtcagtaggaggccctcaggggtccctgatcgcttctctggctccaagtctgccaacacggcctccctgaccgtctctgggctccaggctgaggatgaggctgattattattgcagctcatattcaggcagtaacagggttttcggcggagggaccaagctgaccgtcctaggtcagcccaaggctgccccctcggtcactctgttcccaccctcctcacg

SEQ ID NO: 787497 - DNA, 456 bp, Homo sapiens
  misc_feature: NA.3.36.D03.1.454.light.4.nb
atctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgcagtttattactgtcagcagtatggtacttcacaaaccttcggccaggggacacgactggagattaagcgaactgtggctgcaccatctgtcttcta

SEQ ID NO: 787498 - DNA, 449 bp, Homo sapiens
  misc_feature: NA.19.57.F02.1.454.light.4.nb
ttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttccccctcactttcggcggagggaccaaggtggagatcaagcgaactgtggctgcaccatctgtctt

SEQ ID NO: 787499 - DNA, 486 bp, Homo sapiens
  misc_feature: NA.16.83.H06.1.454.light.4.nb
tcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaaccccactgtcactctgttcccaccctcctcgagtagtaca

SEQ ID NO: 787500 - DNA, 430 bp, Homo sapiens
  misc_feature: NA.12.7.A07.1.454.light.4.nb
agggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaacgttcggccaagggaccaaggtggaaatcaaacgaactagt

SEQ ID NO: 787501 - DNA, 463 bp, Homo sapiens
  misc_feature: NA.16.9.A09.1.454.light.4.nb
aggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgttcccaccctccc

SEQ ID NO: 787502 - DNA, 489 bp, Homo sapiens
  misc_feature: NA.22.86.H09.1.454.light.4.nb
ttgggtttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccaccctcctcacgcg

SEQ ID NO: 787503 - DNA, 459 bp, Homo sapiens
  misc_feature: NA.14.35.D02.1.454.light.4.nb
ttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagatgtggcagtttattactgtcagcaatattatagtactccctacacttttggccaggggaccaagctggagatcaaacgaactgtggctgcacca

SEQ ID NO: 787504 - DNA, 448 bp, Homo sapiens
  misc_feature: NA.14.33.C11.1.454.light.4.nb
ttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccaccctcctcgtactagacg

SEQ ID NO: 787505 - DNA, 461 bp, Homo sapiens
  misc_feature: NA.41.46.E02.1.454.light.4.nb
cacgaccggtgctcgatttagactcatctacagggaaaggggtgatcaggactcctcagttcaccttctcacaatgaggctccctgctcagctcctggggctgctaatgctctgggtctctggatctagtggggatattgtgatgactcagtctccactctccctgcccgtcacccctggagagccggcctccatctcctgcaggtctagtcagagcctcctacataataatggatacaactatttggattggtacctgcagaagccagggcagtctccacagctcctgatctatttgggttctaatcggcccttcggggtccctgacaggttcagtggcagtggctcaggcacagatttttcactgaaaatcagcagagtggaggctgaggatgttggggtttattactgcatgcaaactctacaacctccgctcactttcggcggagggtccaaggtgg

SEQ ID NO: 787506 - DNA, 475 bp, Homo sapiens
  misc_feature: NA.49.50.E06.1.454.light.4.nb
cacgaccggtgctcgatttagatctactgacaacacacaagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcagtggaagtggatctgggacacattttactttcaccatcagcggcctgcagcctgaagattttgcaacatattactgtcaacagtatgaagatctcccactcactttcggcggagggaccaaggtggagatcagacgaactgtggctgca

SEQ ID NO: 787507 - DNA, 420 bp, Homo sapiens
  misc_feature: NA.11.86.H09.1.454.light.4.nb
ttggggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccaccctcctcgtatctctcg

SEQ ID NO: 787508 - DNA, 492 bp, Homo sapiens
  misc_feature: NA.11.67.G01.1.454.light.4.nb
ttggggtttgggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcactctgttcccaccctcctcgtatctctcg

SEQ ID NO: 787509 - DNA, 430 bp, Homo sapiens
  misc_feature: NA.40.2.A02.1.454.light.4.nb
agggggcagggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaagcccctcagctcctgatctatactgcatccactttacaaagtggagtcccatcaaggttcagcggcagtggatctggcacagatttcactctcaccatcagcagcctgcagcctgaagattttgcaacttattactgtctacaagattacaattaccctcggacttttggccaggggacctggctggagatcaaacgaactgt

SEQ ID NO: 787510 - DNA, 474 bp, Homo sapiens
  misc_feature: NA.51.14.B03.1.454.light.4.nb
tccgcggggatcacaccctgtgcaggagtcagaccccgtcaggacacagcatggacatgagggtccccgctcagctcctggggctcctgctgctctggttcccaggttccagatgcgacatccagatgacccagtctccatcctccgtgtctgcatctgtaggagacagagtcaccatgacttgtcgggcgagtcagggtattgacgactacttagcctggcttcagcagaaaccagggaaagcccccaagctcttgatctatgctgcatccaggttggaaagtggggtcccatcaaggttcagcggcagtggatctgggacagatttcactctcaccatcagcagcctgcagcctgaagattttgcaacttattattgtcaacaggctaaaagttaccctctcactttcggcggagggaccaaggtagaaaccaaacgaactgtggctgcaccatctgtcttcatcttccccg

SEQ ID NO: 787511 - DNA, 450 bp, Homo sapiens
  misc_feature: NA.5.6.A06.1.454.light.4.nb
agggggcaggagtcagacccagtcaggacacagcatggacatgagggtccccgctcagctcctggggctcctgctgctctggttcccaggttccagatgcgacatccagatgacccagtctccatcttccgtgtctgcttctataggagacagagtcaccatcacttgtcgggcgagtcagggtcttaacaactacttagcctggtatcagcagaagccagggaaagcccctaagctcctgatctatgctacatccagtttgcaaagtggggtcccttcaaggttcagcggcagtggaactggtatagatttcactctcaccatcaccagcctgcagcctgaagatcttgcaacttactattgtcagcaggctaggaggacgccgtggacgttcggccaagggaccaaggtggaaatcaaacgaactgtggctgcaccatctgtcttcta

SEQ ID NO: 787512 - DNA, 447 bp, Homo sapiens
  misc_feature: NA.26.55.E11.1.454.light.4.nb
ttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccaggggaccaagctggagatcacaggaactgtggctgcaccat

SEQ ID NO: 787513 - DNA, 499 bp, Homo sapiens
  misc_feature: NA.51.5.A05.1.454.light.4.nb
agggcacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcggcggagggacgaagctgaccgtcctgagtcagcccaaggctgccccctcggtcactctgttccccg

SEQ ID NO: 787514 - DNA, 450 bp, Homo sapiens
  misc_feature: NA.49.52.E08.1.454.light.4.nb
tcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccgtcctaggtcagcccaagg

SEQ ID NO: 787515 - DNA, 521 bp, Homo sapiens
  misc_feature: NA.8.4.A04.1.454.light.4.nb
agggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggagggaccaagctgaccgtcctaggtcagcccaaggctgccccctggtcactctgttccccgccctcctcgacacgcgag

SEQ ID NO: 787516 - DNA, 442 bp, Homo sapiens
  misc_feature: NA.51.75.G09.1.454.light.4.nb
agggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggtaatgatgtacactggtaccagcagcttccaggaacagtccccaaactcctcatttatgctaacaccaatcggccctcaggggtccctgcccgattctctggctccaggtctggcacctcagcctccctggccatcactgggctccgggctgaggatgaggctgattattactgccagtcccatgacagcagcctgagtgtgctgttcggcggagggaccaagctgaccgt

SEQ ID NO: 787517 - DNA, 456 bp, Homo sapiens
  misc_feature: NA.40.20.B09.1.454.light.4.nb
agggggggcctcaggaagccgcatcggaggtgcctcagccatggcatggatccctctcttcctcggcgtccttgcttactgcacaggatccgtggcctcctctgagttgactcagccaccctcagtgtccgtgtcccccggacagacagccagcatcacgtgctcaggagatgatttgaacaataaacatgcttgttggtatcaacagaaaccaggccagtcccctgttctggtcatctttgaggattcaaagcggccctcagggatccctgagcgattctctggctccaagtctgcgctcacagccactctgaccatcagcgggacccagcctatggatgaggctgactattattgtcagtcgtgggacagcagcacctcttcctatgtcttcggaactgggacccaggtcaccgtcctcggtcagcccaaggccaaccccactgtcactctgtt

SEQ ID NO: 787518 - DNA, 511 bp, Homo sapiens
  misc_feature: NA.51.83.H06.1.454.light.4.nb
tcgcgggcggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaactgtggctgcaccatctgtcttcatcttcccgccatctgatcgtagcact

SEQ ID NO: 787519 - DNA, 484 bp, Homo sapiens
  misc_feature: NA.16.59.F04.1.454.light.4.nb
tagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcgagtagtaca

SEQ ID NO: 787520 - DNA, 472 bp, Homo sapiens
  misc_feature: NA.52.20.B09.1.454.light.4.nb
agggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcccctgcactggaaccagcggtgacattggtggttataactatgtctcctggtaccaacaccacccaggcaaagcccccaaactcatgatttatgatatcagtgatcggccctcaggggtttcgaatcgcttctctggctccaagtccggcaacacggcctccctgaccatctctgggctccaggccgaggacgaggctgattattattgcagctcatatacaaacaacaacaattgggtgttcggcggagggaccaagctgaccgtcctaggtcagcccaaggctgccccctcggtcactctgttccca

SEQ ID NO: 787521 - DNA, 451 bp, Homo sapiens
  misc_feature: NA.15.3.A03.1.454.light.4.nb
agggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagtattccttttactttcggccctgggaccaaagtggatatcaaacgaactgtggctgcaccat

SEQ ID NO: 787522 - DNA, 481 bp, Homo sapiens
  misc_feature: NA.8.87.H10.1.454.light.4.nb
ttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtcaagtgtgggacaccaacacttgtgtcttcgggactgggaccgaggtcaccgtcctaagtcagcccagggccaaccccactgtcactctgttcccaccctcctcgacacgcgag

SEQ ID NO: 787523 - DNA, 456 bp, Homo sapiens
  misc_feature: NA.22.5.A05.1.454.light.4.nb
agggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcatcttcccgccat

SEQ ID NO: 787524 - DNA, 459 bp, Homo sapiens
  misc_feature: NA.41.2.A02.1.454.light.4.nb
agggggcagggagtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcatggtctcccccttagtttcggcggagggaccaaggttgagatcaaacgaactgtggctgcaccatctgtcttcatcttccccg

SEQ ID NO: 787525 - DNA, 487 bp, Homo sapiens
  misc_feature: NA.12.87.H10.1.454.light.4.nb
ttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccactgtcactctgttcccaccctcctctacgtcgtat

SEQ ID NO: 787526 - DNA, 453 bp, Homo sapiens
  misc_feature: NA.3.19.B08.1.454.light.4.nb
agggggcaggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcaccatctgtcttcta

SEQ ID NO: 787527 - DNA, 443 bp, Homo sapiens
  misc_feature: NA.8.14.B03.1.454.light.4.nb
tccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccatacctttagtgtatattggtatcagcagaagccagggagtcctccccactatctcctgaggtataaaacagactcagataaggagcaggcctctggagtccccagccgcttctctggatccaaagatgctgcggccaatgcagggagtttgctcatctctgggctccagtttgaggatgaggctgactattattgtatgatttggtacaggagcgcttgggtgatcggcggagggaccaagctgaccgtcctaggtcagcccaagg

SEQ ID NO: 787528 - DNA, 329 bp, Homo sapiens
  misc_feature: NA.41.26.C04.1.454.light.4.nb
aaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 787529 - DNA, 464 bp, Homo sapiens
  misc_feature: NA.47.65.F10.1.454.light.4.nb
aggggagctgtgggtagagaagacaggactcaggacaatctccagcatggccagcttccctctcctcctcaccctcctcactcactgtgcagggtcctgggcccagtctgcgttgactcagccaccctcagtgtctgggacccccgggcagacggtcgccgtctcttgttctggaagcggctccaacatcggccgtaattctgtaaactggtaccagcagctcccaggaatggcccccacactcctcatctatagggatgatcagtggccctcaggggtccctgaccgattctctggctccaagtctggcacttcagcctccctggccatcagtgggctccagtctggggatgaggctgattattactgtgcaacatgggatgacagtctgaacgcaatggtgttcggcggagggaccaaggtggccgtcctaggtcagcccaaggctgccccctcggtcactc

SEQ ID NO: 787530 - DNA, 457 bp, Homo sapiens
  misc_feature: NA.53.37.D04.1.454.light.4.nb
ttgggtttgggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctggtcact

SEQ ID NO: 787531 - DNA, 446 bp, Homo sapiens
  misc_feature: NA.51.26.C04.1.454.light.4.nb
ctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctcggtcactctcg

SEQ ID NO: 787532 - DNA, 452 bp, Homo sapiens
  misc_feature: NA.40.40.D07.1.454.light.4.nb
taacaacagaggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaagg

SEQ ID NO: 787533 - DNA, 493 bp, Homo sapiens
  misc_feature: NA.5.23.C01.1.454.light.4.nb
tagggattgggcacgaccggtgctcgatttagtacacgtgattagggattgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcaccatctgtctt

SEQ ID NO: 787534 - DNA, 480 bp, Homo sapiens
  misc_feature: NA.16.85.H08.1.454.light.4.nb
tcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgttcccaccctcctcgagtacg

SEQ ID NO: 787535 - DNA, 445 bp, Homo sapiens
  misc_feature: NA.43.12.B01.1.454.light.4.nb
tccgcgggggcagggagtcagacccagtcaggacacagcatggacatgagggtccccgctcagctcctggggctcctgctgctctggttcccaggttccagatgcgacatccagctgacccagtctccatcttctgtgtctgcatctgtgggagacacagtcaccatcacttgtcgggcgagtcaagttattagtaactggttagcctggtatcagcagaaaccaggaaaagcccctaaactcctgatctatgctgcatccaggttgcagagtggggtcccatcaagattcagcggcagtggatctgggacagatttcactctcactatcagcagcctgcagcctgaagattttgccacttactattgtcaacaggctgacagtttccccttcaccttcggccaagggacacgactggacattaaacgaactgtggctgcaccat

SEQ ID NO: 787536 - DNA, 440 bp, Homo sapiens
  misc_feature: NA.49.4.A04.1.454.light.4.nb
agggggcaggaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcggggggaccgaaggtggagatcaagcgaactgtggctgca

SEQ ID NO: 787537 - DNA, 462 bp, Homo sapiens
  misc_feature: NA.22.15.B04.1.454.light.4.nb
tccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctcggtca

SEQ ID NO: 787538 - DNA, 459 bp, Homo sapiens
  misc_feature: NA.5.28.C06.1.454.light.4.nb
caggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccaaggtggagatcgaacgaactgtggctgcaccatctgtcttcatcttcccgccatctgacgt

SEQ ID NO: 787539 - DNA, 451 bp, Homo sapiens
  misc_feature: NA.41.54.E10.1.454.light.4.nb
aacacacaaagggggatcaggactcctcagttcaccttctcacaatgaggctccctgctcagctcctggggctgctaatgctctgggtcccaggatgcagtggggatgctattctgactcagtcgccgctctccctgcccgtctcccttggacagccggcctccatttcctgcacgtctagtcaaagtctcctacatgatgatggaaacacctacctgacttggtttcaccacaggccaggccaatctccaaggcgcctaatttatcaggtttcgaagcgggactctggggtcccaggcagattcagcggcagtgggtcaggctctgctttcacgctgagaatcaacagggtggaggctgaggatgttggtgtttattactgcatgcaaggttcatattggccgtgcagttttggccaggggaccaagttggagatcaaacgaactgtggc

SEQ ID NO: 787540 - DNA, 450 bp, Homo sapiens
  misc_feature: NA.13.5.A05.1.454.light.4.nb
aggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaa

SEQ ID NO: 787541 - DNA, 463 bp, Homo sapiens
  misc_feature: NA.17.27.C05.1.454.light.4.nb
agggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctgccccctcggtcactc

SEQ ID NO: 787542 - DNA, 446 bp, Homo sapiens
  misc_feature: NA.43.7.A07.1.454.light.4.nb
agggggctggggtctcaggaggcagcactctcgggacgtctccaccatggcctgggctctgctcctcctcagcctcctcactcagggcacaggatcgtggtctcagtctgccctgactcagcctcgctctctatccgggtctcctggacagtcagtcaccatcccctgcactggaaccagcaatgatgttggtacttataatcatgtctcctggtaccaacaatacccaggcaaggcccccaaactcatcatttatcatgtcagtgagcggccctcaggggtccctgatcgcttctctggctccaagtctggcaacacggcctccctgaccatctctgggctccagggtgaggatgaggctgaatattattgctgctcatatgctgtcatgggaggcagtttgtgggtgttcggcggagggacccagctgaccgtcctaggtcacg

SEQ ID NO: 787543 - DNA, 487 bp, Homo sapiens
  misc_feature: NA.51.78.H01.1.454.light.4.nb
agtagtttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtacccctcagctcactttcggcggagggaccaaggtggagatcaaacgaactgtggctgcaccatctgtcttcatcttcccgccatctgatcgtagcact

SEQ ID NO: 787544 - DNA, 432 bp, Homo sapiens
  misc_feature: NA.4.75.G09.1.454.light.4.nb
aggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcactgggaccaaggtcaccgtcctaggtcagaccccg

SEQ ID NO: 787545 - DNA, 508 bp, Homo sapiens
  misc_feature: NA.5.24.C02.1.454.light.4.nb
tagggaaagggcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgccccccg

SEQ ID NO: 787546 - DNA, 438 bp, Homo sapiens
  misc_feature: NA.10.74.G08.1.454.light.4.nb
agggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgcagtttattactgtcagcagtatactaactggcctctgacgttcggccaagggaccagggtggaaatcaaacgaactgtggctgcaccat

SEQ ID NO: 787547 - DNA, 492 bp, Homo sapiens
  misc_feature: NA.43.57.F02.1.454.light.4.nb
ttgggtttgggcacgaccggtgctcgatttagctcgatatagttgggtttggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtcctaggtcagcccaaggctgccccctcggtcactctgttcccaccctcctcactactcaca

SEQ ID NO: 787548 - DNA, 494 bp, Homo sapiens
  misc_feature: NA.5.86.H09.1.454.light.4.nb
ttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtcactctgttcccaccctcctccgtgtctgat

SEQ ID NO: 787549 - DNA, 468 bp, Homo sapiens
  misc_feature: NA.12.48.E04.1.454.light.4.nb
agcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctcggtcactc

SEQ ID NO: 787550 - DNA, 487 bp, Homo sapiens
  misc_feature: NA.11.75.G09.1.454.light.4.nb
aggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccta

SEQ ID NO: 787551 - DNA, 469 bp, Homo sapiens
  misc_feature: NA.53.8.A08.1.454.light.4.nb
agcctagctgtgctgtgggtccaggaggcagaactctgggtgtctcaccatggcctggatccctctacttctccccctcctcactctctgcacaggctctgaggcctcccatgagttgatacagccatcctcggtgtcagtgtccccaggacagacggccacgattatttgctctggagatgcattggcaaagcaatttgcttcttggttccagcagaagccaggccaagcccctgtactggtgatttataaaggctctgagaggcccccagggatccctgagcgattctctgggtccgactcagggacaacagccatgttgaccatcagtggagtccaggcagaagacgaggctgactattattgtcagtcagcagacaacactgttgtttctgtgtttttcggcggagggaccaggctgaccgtcctgggtcagcccaaggctgccccctcggtcactctgttcccc

SEQ ID NO: 787552 - DNA, 464 bp, Homo sapiens
  misc_feature: NA.15.66.F11.1.454.light.4.nb
aggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaaccccactgtcactctgttcccaccct

SEQ ID NO: 787553 - DNA, 449 bp, Homo sapiens
  misc_feature: NA.41.67.G01.1.454.light.4.nb
ttgggtttggggagagctctggggagtctgcaccatggcttggaccccactcctcttcctcaccctcctcctccactgcacagggtctctctcccagcttgtgctgactcaatcgccctctgcctctgcctccctgggaacctcggtcaagctcacctgcactctgagcagtggagacagcagacacgccatcgcatggcatcagcagcagccaggaaggggccctcgattcctgatgaaacttacttttgatggcagccacaccaagggggacggatccctgatcgcttctcaggctccagctctggggctgagcgctacctttcgatctccagcctccagtctgaggatgaggctgactattactgtcagtcctgggacaggggcgttttggtgttcggcggagggaccagactgaccgtcctgggtcagcccaaggctgccccctc

SEQ ID NO: 787554 - DNA, 459 bp, Homo sapiens
  misc_feature: NA.48.31.C09.1.454.light.4.nb
tcaggctggaactgaggagcaggtgggggcacttctccctctaacactctccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcggccaagggaccaaggtggaagtcagacgaactgtggctgcaccatctgtcttcatcttcccg

SEQ ID NO: 787555 - DNA, 455 bp, Homo sapiens
  misc_feature: NA.11.10.A10.1.454.light.4.nb
aggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaagggaccaaggtggaagtcaaacgaactagtggctgcaccatctgtcttcatcttcccgt

SEQ ID NO: 787556 - DNA, 478 bp, Homo sapiens
  misc_feature: NA.40.60.F05.1.454.light.4.nb
gggaaagggggagctgctcagttaggacccagagggaaccatggaaaccccagcgcagcttctcttcctcctgctactctggctcccagagacccccggagaaattgtgttgacgcagtctccaggcaccctgtctttgtctccaggggaaagagccaccctctcctgcagggccagtcagagtgtaaccaacaactacttaatgtggtaccagcaaaaacctggccaggctcccaggctcctcatctatggtgcatccaacagggccagtggcatcccagacaggtttagaggcagtggggccgacacagacttcactctcaccatcagcagactggagcctgaagattttgcactgtattactgtcaccagtctgctcacgtacctctcactttcggcggagggaccaaggtggagatcaaacgaactgtggctgcaccatctgtcttcatcttcccgccatctgaagtcgctaga

SEQ ID NO: 787557 - DNA, 478 bp, Homo sapiens
  misc_feature: NA.41.18.B07.1.454.light.4.nb
agggggggagcctagctgtggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcactctcgttccccg

SEQ ID NO: 787558 - DNA, 456 bp, Homo sapiens
  misc_feature: NA.4.64.F09.1.454.light.4.nb
aggggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgcaacttacttttgtcaacagactaactcattccctcgcagttttggccaggggaccaaggtggagatcaaacgaactgtggctgcaccatctgtcttcattcttccccg

SEQ ID NO: 787559 - DNA, 408 bp, Homo sapiens
  misc_feature: NA.53.72.G06.1.454.light.4.nb
ctgggcctcaggaagcagcatcggaggtgcctcagccatggcatggatccctctcttcctcggcgtccttgcttactgcacaggatgcgtggcctcctatgagctgactcagccaccctcagtgtccgtgtccccaggacagacagccagcatcacctgctctggagacaagttgggggataaatatgctggctggtatcagcagaagccaggccagtcccctgtgttagtcatctatcaagatacaaagcggccctcagggatccctgagcgattctctggctccaactctgggaacacagccactctgaccatcagcgggactcaggctatcgatgaggctgactattactgtcaggcgtgggacagccgcactggggtgttcggcggagggaccaagctgaccgt

SEQ ID NO: 787560 - DNA, 477 bp, Homo sapiens
  misc_feature: NA.14.5.A05.1.454.light.4.nb
aggggggaactgctcagttaggacccagagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctcctgcgctcactttcggcggagggaccaaggtggagatcaaacgaactgtggctgcaccatctgtcttcatcttcccgccatctgagtactagacg

SEQ ID NO: 787561 - DNA, 434 bp, Homo sapiens
  misc_feature: NA.5.45.E01.1.454.light.4.nb
cacttctccctctaacactctccccgctcagctcctggggctcctgctgctctggttcccaggttccagatgcgacatccagatgacccagtctccttctttcgtgtctgcgtctgtaggagacagacttactatcgcttgtcgggcgagtcaggatattagtaccaggttagcctggtatcagcagaagcctgggagagcccctaaactcctgatctatgctgcatcaagtctgcaaagtggggtcccatcgaggttcagaggcagtggatctgggacagatttcactctcaccatcagcggcctgcagcctgaagattatgcaacttactattgtcaaagttctaatgctttcccgcgcacgtttggccaggggaccaaggtagagatcaaacgaactgtggctgcaccatctgtcttcatcttcccgccat

SEQ ID NO: 787562 - DNA, 468 bp, Homo sapiens
  misc_feature: NA.10.29.C07.1.454.light.4.nb
agggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaaccagcagcacttctgtattcggcggagggaccaagctgaccgtcctaggtcagcccaaggctgccccctcggtcactct

SEQ ID NO: 787563 - DNA, 480 bp, Homo sapiens
  misc_feature: NA.5.59.F04.1.454.light.4.nb
tagggattgggggctctggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccaagggaccgaaggtggaaagtacaaacgaactagtggctgcaccactctgtcttcatcttccccgccta

SEQ ID NO: 787564 - DNA, 445 bp, Homo sapiens
  misc_feature: NA.13.59.F04.1.454.light.4.nb
tagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtggctgcacc

SEQ ID NO: 787565 - DNA, 463 bp, Homo sapiens
  misc_feature: NA.9.21.B10.1.454.light.4.nb
agagaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctc

SEQ ID NO: 787566 - DNA, 492 bp, Homo sapiens
  misc_feature: NA.16.1.A01.1.454.light.4.nb
aggagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccgccctcctcgagtagtaca

SEQ ID NO: 787567 - DNA, 455 bp, Homo sapiens
  misc_feature: NA.3.58.F03.1.454.light.4.nb
aagggaaagggggaggaactgctcagttaggacccagagggaaccatggaagccccagctcagcttctcttcctcctgctactctggctcccagataccaccggagaagttgtgttgacacagtctccagccaccctgtctttgtctccgggggaaagagccaccctctcctgcagggccagtcagagtgttagcagatacttagcctggtaccaacagaaacctggccaggctcccaggctcctcatctatgatgcgtccaacagggccactggcatcccagccaggatcagtggcagtgggtctgggacagacttcactctcaccatcagtagcctagagcctcaagattttgctagtttattattgtcaccaccgagccacgttcggccaagggaccaaggtggaaatcaaacgaactgtggctgcaccatctgtcttcatcttcccgccat

SEQ ID NO: 787568 - DNA, 460 bp, Homo sapiens
  misc_feature: NA.53.30.C08.1.454.light.4.nb
aagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctgtt

SEQ ID NO: 787569 - DNA, 440 bp, Homo sapiens
  misc_feature: NA.11.17.B06.1.454.light.4.nb
agggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaaggtggaaatcaaacgaactagtggctgcacca

SEQ ID NO: 787570 - DNA, 448 bp, Homo sapiens
  misc_feature: NA.51.13.B02.1.454.light.4.nb
tccgcgggggcaggagtcagtcccaaccaggacacagcatggacatgagggtccctgctcagctcctggggctcctgctgctctggctctcaggtgccagatgtgacatccagatgtcccagtctccatcctccctgtctgcatctgttggagacagagtcaccatcacttgccagacaagtcacgacgttcgcagatatttaagctggtatcagcagagaccagggaaagcccctaaactcctgatatacgatgcatcccatttgggagcaggggtcccatcaagattcagtggaagtggatctgggacacattttactttcaccatcagtagcctgcagcctgaagatgtcgccacatattactgtcaacagcatgataatctctccaccttcggccaagggacacgactggaaattaaacgagctgtggctgcaccatctgtctt

SEQ ID NO: 787571 - DNA, 459 bp, Homo sapiens
  misc_feature: NA.41.59.F04.1.454.light.4.nb
tagggattgggggcaggagtcagacccagtcaggacacagcatggacatgagggtccccgctcagctcctggggctcctgctgctctggttcccaggttcccgatgcggcatccagatgacccagtctccatctttcgtgtctgcatctataggagacagagtcaccatcacttgtcgggcgagtcaggatattaggacgtggttagcctggtatcgacagagaccgggaagagcccctgaactcctcgtctatgatgcatccactttacatcgtggggtcccatcacggttcagcggcagtggatctgggacagacttcagtctcaccatcagtaccctgcagcctgacgattttgctaatttatttttgtcaacaggctaataggttccctacaaacattcggccctgggaccagagtggatttgaagcgaactgtggctgcaccatctgtcttcta

SEQ ID NO: 787572 - DNA, 465 bp, Homo sapiens
  misc_feature: NA.18.37.D04.1.454.light.4.nb
ttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcaccatctgtt

SEQ ID NO: 787573 - DNA, 460 bp, Homo sapiens
  misc_feature: NA.10.43.D10.1.454.light.4.nb
agggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtcttcat

SEQ ID NO: 787574 - DNA, 432 bp, Homo sapiens
  misc_feature: NA.8.67.G01.1.454.light.4.nb
ttgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtcttcatcttcccgccatctgagacacgcgag

SEQ ID NO: 787575 - DNA, 426 bp, Homo sapiens
  misc_feature: NA.19.14.B03.1.454.light.4.nb
tccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtggttataactatgtctcctggtaccaacaacacccaggcaaggcccccaaagtcatgatttatgatgtcagtgagcggccctcaggggtccctgatcgcttctctggctccaagtctggcaacacggcctccctaaccatctctgggctccaggctgaggatgaggctgattattactgctgctcatatgcaggcaggtactacgtttggtattcgggcggagggaccaag

SEQ ID NO: 787576 - DNA, 458 bp, Homo sapiens
  misc_feature: NA.53.14.B03.1.454.light.4.nb
tccgcgggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtctaggtcagcccaaggctgccccctcggtcactctcg

SEQ ID NO: 787577 - DNA, 447 bp, Homo sapiens
  misc_feature: NA.17.35.D02.1.454.light.4.nb
ttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtctt

SEQ ID NO: 787578 - DNA, 474 bp, Homo sapiens
  misc_feature: NA.7.87.H10.1.454.light.4.nb
ttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaacggaccgaacggtaggaaggtacgaaacgaactagtggcgtgcaccatctgtcttctatcttcccgccact

SEQ ID NO: 787579 - DNA, 447 bp, Homo sapiens
  misc_feature: NA.52.77.G11.1.454.light.4.nb
aagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcggcgggggaccaaggtggagatcaaacgaactgtggctgcaccatctgtt

SEQ ID NO: 787580 - DNA, 447 bp, Homo sapiens
  misc_feature: NA.8.12.B01.1.454.light.4.nb
tccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctgccccccg

SEQ ID NO: 787581 - DNA, 485 bp, Homo sapiens
  misc_feature: NA.4.22.B11.1.454.light.4.nb
agggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttctgcatgcaaggtacacactggccgtacacttttggccaggggaccaagctggagatcaaacgaactgtggctgcaccatctgtcttcatcttcccgccatctgactacagtgct

SEQ ID NO: 787582 - DNA, 495 bp, Homo sapiens
  misc_feature: NA.43.79.H02.1.454.light.4.nb
agggaaagggcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctcagcgtctgggacccccgggcagagggtcaccatctcttgttctggaagcagctccaacatcggaagtaattatgtatattggtaccagcagctcccaagaacggcccccaaattcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtgtggtattcggcggagggaccaagctgaccgtcctaggtcagccc

SEQ ID NO: 787583 - DNA, 458 bp, Homo sapiens
  misc_feature: NA.40.80.H03.1.454.light.4.nb
aagggaaagggggaggaactgctcagttaggacccagagggaaccatggaagccccagctcagcttctcttcctcctgctactctggctcccagataccgccggagaaattgtgttgacacagtctccagccaccctgtctttatctccaggggaaagagccatcctctcctgcagggccagtcagaatattgatacatacttagcctggtaccagcagaaacctggcctggctcccagggtcctcatccatgatgcctcccacagggccactggcatcccacacaggttcagtggcagtgggtctgggacagacttcagtctcaccatcagcagcctagagcctgaggattttgcaatttatttctgtcaacagcgtagcacctggccccgggtcaccttcggccaagggacacgactggacatgaaacgaactgtggctgcaccatctgtcttcat

SEQ ID NO: 787584 - DNA, 486 bp, Homo sapiens
  misc_feature: NA.10.12.B01.1.454.light.4.nb
tccgcgggggcctggggagcctagctgtgctgtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggcccctgtggaacttgtatataaggacactgagaggcccccagggatccctgagcgattctctggctccagctcagggacaacagtgacgttgaccatcagcggagcccgggcagaggacgaggctgactattactgtcaatcacaagacattactggtacttattgggtgttcggcggagggtccaagctgaccgtcctaggtcagcccaaggctgccccctcggtcactctgttccca

SEQ ID NO: 787585 - DNA, 393 bp, Homo sapiens
  misc_feature: NA.18.5.A05.1.454.light.4.nb
agggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggccaggggaccaagctggagatcaaacgaactgtggctgcaccatctgtcttcatcttcccgccatctgacatactcgta

SEQ ID NO: 787586 - DNA, 473 bp, Homo sapiens
  misc_feature: NA.10.75.G09.1.454.light.4.nb
aggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaactgaccgtccttcgtcagcccaaggctgccccctcggtcactctgttcccaccct

SEQ ID NO: 787587 - DNA, 449 bp, Homo sapiens
  misc_feature: NA.14.55.E11.1.454.light.4.nb
ttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttctcc

SEQ ID NO: 787588 - DNA, 403 bp, Homo sapiens
  misc_feature: NA.51.42.D09.1.454.light.4.nb
agggaaagggggaagagctgctcagttaggacccagagggaaccatggaaaccccagcgcagcttctcttcctcctgctactctggctcccagatactaccggagaaattgtgttgacgcaatcgccaggcaccctgtctttgtctccaggggagagagccaccctctcttgcagggccagtcagactattggcatcaactacctagcctggtaccaacagaagcctggccaggctcccagactcctcctttttggtgcatccagcagggccactggcgtcccagacaggttcagtggcagtgggtctgggacagacttcgctctcaccatcagcagagtggagcctgaagattttgcagtgtattactgtcagcagtataatctactacctcggacgttcgg

SEQ ID NO: 787589 - DNA, 443 bp, Homo sapiens
  misc_feature: NA.52.58.F03.1.454.light.4.nb
aagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggcaaatatttaaattggtatcagcagaaaccagggaaagcccctagactcctgatctatgctgcctccaatttgcaaagtggcgtcccatcgaggttcagtggccggggatctgggacagacttcactctcaccatcagcggtcttcaacctgaggactttggaacttactactgtcagcagagtgataatacccctcagactttcggccctgggactacagtggatgtcaaacgaactgtggctgcaccat

SEQ ID NO: 787590 - DNA, 454 bp, Homo sapiens
  misc_feature: NA.43.61.F06.1.454.light.4.nb
agagctctggagaagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtacacttttggccaggggaccaagctagaaatcaaacgaactgtggctgcaccatctgtctt

SEQ ID NO: 787591 - DNA, 452 bp, Homo sapiens
  misc_feature: NA.48.75.G09.1.454.light.4.nb
aggggactgatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccggggaccaaggtggatctcaaaagaactgtggctgcacca

SEQ ID NO: 787592 - DNA, 448 bp, Homo sapiens
  misc_feature: NA.11.76.G10.1.454.light.4.nb
agggggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccaggggaccaggctggagatcagacgaactgtggc

SEQ ID NO: 787593 - DNA, 443 bp, Homo sapiens
  misc_feature: NA.13.42.D09.1.454.light.4.nb
agggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccaagggaccaaggtggaaatacaaacgaactagtggctgca

SEQ ID NO: 787594 - DNA, 452 bp, Homo sapiens
  misc_feature: NA.14.30.C08.1.454.light.4.nb
aagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgacacccttttaaattggtatcagcagaagccagggaaagcccctaaacttctgatctatgatgcaaccaatttacaagatgggatcccatcaaggttcagtggcggtggatctggggcggatttcactctcaccatcagcagtctgcaacctgaagattttgcgacttactggtgtcaacagggttatcataacccgtacacttttggccaggggaccaagctggacatcatacgaactgtggctgcaccatctgtt

SEQ ID NO: 787595 - DNA, 459 bp, Homo sapiens
  misc_feature: NA.11.21.B10.1.454.light.4.nb
aggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcatcttccccg

SEQ ID NO: 787596 - DNA, 443 bp, Homo sapiens
  misc_feature: NA.22.77.G11.1.454.light.4.nb
aagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgtacccccccacgttcggcggagggaccacagtcgagatcaaacgaactgtggctgcaccat

SEQ ID NO: 787597 - DNA, 456 bp, Homo sapiens
  misc_feature: NA.7.5.A05.1.454.light.4.nb
aggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgaatcgcttctctggctccaagtctggcgacacggcctccctgaccatctctgggctccaggctgaagacgaggctgattattactgcagctcatatacaggcagcagcactcaggttttcggcggagggaccaagctgaccgtcctaggtcagcccaaggctgccccctcggt

SEQ ID NO: 787598 - DNA, 468 bp, Homo sapiens
  misc_feature: NA.2.21.B10.1.454.light.4.nb
agagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcactctcg

SEQ ID NO: 787599 - DNA, 487 bp, Homo sapiens
  misc_feature: NA.9.25.C03.1.454.light.4.nb
ctgggcctaaggaagcagcactggtggtgcctcagccatggcctggaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcggggtcgaagccggggatgaggccgactatttctgtcagctgtgggattctcatgatggtagtgggggaatcttcggcggagggaccaggctgaccgtcctaagtcagcccaaggctgccccctcggtcactctgttcccaccctcctcagacgtatca

SEQ ID NO: 787600 - DNA, 444 bp, Homo sapiens
  misc_feature: NA.22.59.F04.1.454.light.4.nb
tagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgctagtttattactgtcagcactataataactggcctccgtacagttttggccaggggaccaagctggagatcaaacgaactgt

SEQ ID NO: 787601 - DNA, 441 bp, Homo sapiens
  misc_feature: NA.3.38.D05.1.454.light.4.nb
ttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccaaggtggagatcaaacgaactgtggctgcacca

SEQ ID NO: 787602 - DNA, 512 bp, Homo sapiens
  misc_feature: NA.51.43.D10.1.454.light.4.nb
agggcacgaccggtgctcgatttagactagcagtaaggggctgggcctaaggaagcagcactggtggtgcctcagccatggcctggaccgttctcctcctcggcctcctctctcactgcacagtctctgtgacatcctatgtgctgactcagccaccctcggtgtcagtggccccaggacagacggccaggatttcctgtgggggagacaacattggaagtaaaagtgtacactggtaccagcagaggccaggccaggcccctgtgttggtcgtctatgattataacgaccggccctcagggatccctgaccgattctctggctccatctctgggaacacggccactctgaccatcagcagggtcgaagccggggatgaggccgactattactgtcaggtgtgggaaagtagtagtgatcattatgtcttcggaagtgggaccaaggtcaccgtcctaggtcagcccaaggccaaccccactgtcactctgttcccaccctcctctcgtacg

SEQ ID NO: 787603 - DNA, 465 bp, Homo sapiens
  misc_feature: NA.2.35.D02.1.454.light.4.nb
ttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtcactc

SEQ ID NO: 787604 - DNA, 485 bp, Homo sapiens
  misc_feature: NA.41.42.D09.1.454.light.4.nb
agggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagagccaccctctcctgcagggccagtcagagtcttagcggcaccttagcctggtaccagcagaaacctggccaggctcccaggctcctcatctatggtacatccaccagggtcactggtgttccagccaggttcagtggcagtgggtccgggacagagttcactctcaccatcagcagcctgcagtctgaagattttgcgatttattactgtcaccactataataattggccctccgcgtggacgttcggccaagggaccaaggtggaaatcaaacgaactgtggctgcaccatctgtcttcatcttcccgccatctgaatagtataga

SEQ ID NO: 787605 - DNA, 471 bp, Homo sapiens
  misc_feature: NA.53.4.A04.1.454.light.4.nb
aggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggttatcatctcctgcactgggaccagctccaacatcgggtcaggttatgatgtacactggtaccagcagcttccaggaacagcccccaaactcctcgtctatggtgacggcagtcggccctcaggggtccctggccgattctctggctccaagtctggcacctcagcctccctggccatcactgggctccaggctgaggatgagggtcattattactgccagtcctatgacaacagaatggatccttcttgggtgttcggcggagggaccaagctgaccgtcctacgtcagcccaaggctgccccctc

SEQ ID NO: 787606 - DNA, 461 bp, Homo sapiens
  misc_feature: NA.41.6.A06.1.454.light.4.nb
aggggagagggctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgcca

SEQ ID NO: 787607 - DNA, 456 bp, Homo sapiens
  misc_feature: NA.43.20.B09.1.454.light.4.nb
aggggagagggaagagctgctcagttaggacccagagggaaccatggaaaccccagcgcagcttctcttcctcctgctactctggctcccagataccaccggagaaattgtgttgacgcagtctccgggcaccctgtctttgtctccaggggatagagccaccctctcctgcagggccagtcagagtgttagcagcacctacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcaccagtatggtagctcacctaagacgttcggccaagggaccaaggtggaaatcaaacgaactgtggctgcaccatctgtcttcta

SEQ ID NO: 787608 - DNA, 489 bp, Homo sapiens
  misc_feature: NA.43.73.G07.1.454.light.4.nb
agggcacgaccggtgctcgatttagctctacgctcagggggagagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatggcgggatccaagggggatggcatccctgatcggttctcagtcttgggctcaggcctgactcggtccctgaccatcaacaacatccaggaagaggatgacagtgactactactgtgggacgaattatggcagtgggaatacctacatgtatgtctttggaagtgggacgaaggtcaccgtccaaggtcacg

SEQ ID NO: 787609 - DNA, 480 bp, Homo sapiens
  misc_feature: NA.49.10.A10.1.454.light.4.nb
aggggagtctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcg

SEQ ID NO: 787610 - DNA, 469 bp, Homo sapiens
  misc_feature: NA.52.71.G05.1.454.light.4.nb
aaaaggccctgaggagaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctcctaatttctaccccagctggtaccagcagaccccaggccaggctccacgcacgctcatctacagcacaattactcgctcttctggggtccctgatcgcttctctggctccatccttgggaacaaagctgccctaaccatcacgggggcccaggcagatgatgaatctgattattactgtgtcctctatatgggtagtggcatttggatgttcggcggagggaccaagctgaccgtcctgggtcagcccaa

SEQ ID NO: 787611 - DNA, 447 bp, Homo sapiens
  misc_feature: NA.7.85.H08.1.454.light.4.nb
tcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtcagaccccg

SEQ ID NO: 787612 - DNA, 463 bp, Homo sapiens
  misc_feature: NA.52.6.A06.1.454.light.4.nb
agggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaagcagaaacacttgggtgttcggcggcgggaccaaactgaccgtcctacgtcagcccaaggctgccccctcggtcact

SEQ ID NO: 787613 - DNA, 461 bp, Homo sapiens
  misc_feature: NA.18.23.C01.1.454.light.4.nb
tagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaatttcccgctcactttcggcggagggaccaaggtggagatcaaacgaactgtggctgcaccatctgtcttcatcttccccg

SEQ ID NO: 787614 - DNA, 482 bp, Homo sapiens
  misc_feature: NA.48.39.D06.1.454.light.4.nb
cagttctttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 787615 - DNA, 453 bp, Homo sapiens
  misc_feature: NA.22.29.C07.1.454.light.4.nb
agggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgctagtttattactgtcagcagtataattactggcctcggacgttcggccaagggaccgaaggtggaagtcaaacgaactagtggctgcaccatctgtctt

SEQ ID NO: 787616 - DNA, 462 bp, Homo sapiens
  misc_feature: NA.48.8.A08.1.454.light.4.nb
agggggaggaacccctcagttaggacccagagggaaccatggaagccccagctcagcttctcttcctcctgctactctggctcccaggttttaccggagagattgtgttgacacagtctccagtcaccctgtcattgtctccagggcaaagagccaccctctcctgcagggccaatgagagtattggcaacttcttaggctggtatcaacaaaagcctggccaggctcccaggctcctcatctatgatgcatcccatagggccagaggcatcccagccaggttcagtggcagtgggtctgggacagacttcactctcaccatcagcaccctagaacgtgaagattttgcagtttattactgtcagcaccgtaaaacctggcctctgagtggttttggccaggggaccaagctggacatcaaacgaactgtggctgcaccatctgtcttcatcttcccgccta

SEQ ID NO: 787617 - DNA, 508 bp, Homo sapiens
  misc_feature: NA.52.4.A04.1.454.light.4.nb
agggcacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacagaagcactctggtgttcggcggagggaccaggctgaccgtcctaggtcagcccaaggctgccccctggtcactctgttcccaccctcctctatacgatcg

SEQ ID NO: 787618 - DNA, 460 bp, Homo sapiens
  misc_feature: NA.15.37.D04.1.454.light.4.nb
ttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatattactaggtggttggcctggtatcagcagaaaccagggaaggcccctaagtccctcatcaagaaggcgtctactttagaagctggggtcccgtcaagattcagcgccggtggatctgggacagaattcactctcaccatcaacagcctggaacctgatgattttgcaacttattactgccaacactatgatactcacccgtacacttttggccaggggaccaagctggagatcaaaggaactgtggctgcaccatctgtcttcatcttcccg

SEQ ID NO: 787619 - DNA, 475 bp, Homo sapiens
  misc_feature: NA.3.46.E02.1.454.light.4.nb
cacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccaacagaaacctggccaggctcccaggctcctcattcatggtgcatctaacagggccgatggcattccagccaggttcagtggcagtggatatgggacagacttcactctcaccatcagcaatctgcagtctgaagattttgcagtttatttctgtcagcagtttaacacctggcctggaagttttggccaggggaccaagctggagctcaaacgaactgtggctgcaccat

SEQ ID NO: 787620 - DNA, 379 bp, Homo sapiens
  misc_feature: NA.47.3.A03.1.454.light.4.nb
agaggagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatga

SEQ ID NO: 787621 - DNA, 507 bp, Homo sapiens
  misc_feature: NA.13.23.C01.1.454.light.4.nb
tagggattggggcagcttcggctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctgaaagcagctccaacaccggaactggtgatataaactggtaccagcagctcccaggaacggcccccaaactcctcatctatactaataatcaccggccctcagggatccctgaccgattctctgcctccaagtctggcacctcagcctccctggccatcagtcggctccagtctgaggatgaggctgattattactgtgcagcatactatgacaccctgaatggtctttgggtgttcggcggagggaccaagctgaccgtcctaggtcagcccaaggctgccccctcggtcactctgttcccaccctcctctagtacgtga

SEQ ID NO: 787622 - DNA, 437 bp, Homo sapiens
  misc_feature: NA.40.1.A01.1.454.light.4.nb
agggggcaggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaaccagggaaagcccctaagctcctgatctacgatgcatctaagttggaaacaggggtctcatcaaggttcagtggaagtggatctgggacagatcctactttcaccatcagcagcctgcagccagaagatattgcgacatatttctgtcaggtgtatgaaagtctccctgttttggtccaggggaccaaggtggagatcaaacgaactgtggctgcaccat

SEQ ID NO: 787623 - DNA, 514 bp, Homo sapiens
  misc_feature: NA.43.71.G05.1.454.light.4.nb
cacgaccggtgctcgatttagtgtcgtcgcaagagagaggggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgaactactcaca

SEQ ID NO: 787624 - DNA, 455 bp, Homo sapiens
  misc_feature: NA.49.67.G01.1.454.light.4.nb
ttgggtttggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgtt

SEQ ID NO: 787625 - DNA, 488 bp, Homo sapiens
  misc_feature: NA.48.83.H06.1.454.light.4.nb
tgagggtttagaacctatgaacattctgtaggggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgttcccaccctcct

SEQ ID NO: 787626 - DNA, 438 bp, Homo sapiens
  misc_feature: NA.13.34.D01.1.454.light.4.nb
ttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacgactggagattaaaggaa

SEQ ID NO: 787627 - DNA, 555 bp, Homo sapiens
  misc_feature: NA.21.22.B11.1.454.light.4.nb
agggtggggtcaaaaacccggggaggggggtctgatttgcatggatggactctccccctctcagagtacgaagagagggagagatctggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaa

SEQ ID NO: 787628 - DNA, 434 bp, Homo sapiens
  misc_feature: NA.51.61.F06.1.454.light.4.nb
agtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttctttagcctggtatcagcaaaaaccagggaaagcccctaagctcctgatctatgctgcatccactttgcaaactggagtcccatcaaggttcagcggcagtggatctgggacagaattcactctcacaatcagcagcctgcagcctgaagattttgcaacttattactgtcaacagcttaatacttatcctcggacgttcggcggagggaccaaggtggagatcaaacgaactgtggctgcaccatctgt

SEQ ID NO: 787629 - DNA, 456 bp, Homo sapiens
  misc_feature: NA.22.9.A09.1.454.light.4.nb
agggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctgcaccatctgtcttcatcttccccg

SEQ ID NO: 787630 - DNA, 434 bp, Homo sapiens
  misc_feature: NA.4.79.H02.1.454.light.4.nb
agggaaaggggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctcctcatctctgatgcctccactctgcacggtggcgtcccgccaacgttcagcggcagcggatctgggacagaattcagcctcaccatcagcagcctgcagcctgatgatgttgcaacttactactgtcaacaatataacagttactggacgttcggccaagggaccaaggtggaactcaaacgaactgtggctgca

SEQ ID NO: 787631 - DNA, 465 bp, Homo sapiens
  misc_feature: NA.43.4.A04.1.454.light.4.nb
agggtcattaatgtcagcggcacagcaaccgcgggcactttcggcggagggaccaaggtggagatcaagcgtgagtgcactttcctagtgctttttcttataaggcctgaaatttggagtctttttgtgtttgagacattacctcaggtccattccagagagttccagaggtccattccagagagttccagaggctttcaaaaaggtccgatgagtaagggatcgaaagttagtccatcttaaggagcagccaagcgctggtcagttaagagcggcgcctcatttgcaagattttctctgcgtcggccaggttagtgatcttcacgacgaaaagacatttttcttgagggaaaagtaattaagttaatgttgtggatcagcttcggccaagggacgcgactggagattaaacgaactgtggctgcaccatctgtcttcatcttcccgccatctgaactactcaca

SEQ ID NO: 787632 - DNA, 482 bp, Homo sapiens
  misc_feature: NA.12.21.B10.1.454.light.4.nb
agagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccgccctt

SEQ ID NO: 787633 - DNA, 484 bp, Homo sapiens
  misc_feature: NA.5.40.D07.1.454.light.4.nb
taacaacagagggtgctcgatttagtgatagagcgtaacaacagagggggaggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggaccaaggtggagaccaaacgaactgtggctgcaccatctgtt

SEQ ID NO: 787634 - DNA, 505 bp, Homo sapiens
  misc_feature: NA.49.19.B08.1.454.light.4.nb
aggggaagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcaactccaacattgggaagaattatgtatcgtggtaccagcagttcccaggaagggcccccagactcctcattcatgacaatagcaagcgagtcccagagattcctgaccgattctctggctccaagtctggcacctcagccaccctggccatcaccggactccagactggggacgaggccgattattactgcggaacatgggattccagcctgagtggtgtcagggtgttcggcggagggaccaagctgaccgtcctaggtcagcccaaggctggcccctcggtcactctgttcccgccctcctctctctcgact

SEQ ID NO: 787635 - DNA, 479 bp, Homo sapiens
  misc_feature: NA.22.30.C08.1.454.light.4.nb
aagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctcacgcg

SEQ ID NO: 787636 - DNA, 461 bp, Homo sapiens
  misc_feature: NA.52.82.H05.1.454.light.4.nb
agcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaaccccactgtcactctcg

SEQ ID NO: 787637 - DNA, 460 bp, Homo sapiens
  misc_feature: NA.10.36.D03.1.454.light.4.nb
atctctcttggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaatgtcgggagagataatgtgtactggtaccagcaggtcccaggaacggcccccaaactcctcatctataacgattatcggcggccctcaggggtccctgaccgattctctggctccaagtctggcacctcagcctccctggccatcagtgggctccggtccgaggatgacgctgattattactgtgtagcatgggatgacagcctgagtgcttatgtcttcggaactgggaccaaggtcaccgtcctacgtcagcccaaggccaaccccactgtcta

SEQ ID NO: 787638 - DNA, 465 bp, Homo sapiens
  misc_feature: NA.12.55.E11.1.454.light.4.nb
ttgggtttgggggtggtagctcaggaagcagagcctggagcatctccactatggcctgggctccactacttctcaccctcctcgctcactgcacaggttcttgggccagctttttgctgactcagccccactctgtgtcggggtctccggggaagacggtaaccatctcctgcaccggcagcagtggcaacattgccacgaagtatgtgcagtggtaccagcagcgcccgggcagtgcccccaccactataatctatgaggatgaccgacgaccctctggggtccctgatcgtttctctggctccatcgacagctcctccaattctgcctccctcaccatctctggactcatgtctgaggacgaggctgactactactgtcagtcttatgataatacgtcttgttttttcggcggtcgggaccaagctgaccgtcctaggtcagcccaaggctgccccctcggtc

SEQ ID NO: 787639 - DNA, 440 bp, Homo sapiens
  misc_feature: NA.51.73.G07.1.454.light.4.nb
agggcacgaccggtgctcgatttagtatctgatagttcggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactg

SEQ ID NO: 787640 - DNA, 464 bp, Homo sapiens
  misc_feature: NA.9.24.C02.1.454.light.4.nb
tagggaaagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggctcccaggctcctcatttatgatgcatccaacagggccactggcgtcccagccaggttcagtggcagtgggtctgggacagacttcactctcaccatcagcagcctagagcctgaagattttgctattttattactgtcagcagcgtgccaagtggcttctcactttcggcggagggaccaaggtggagaccagacgaactgtggctgcaccatctgtcttcatcttccccg

SEQ ID NO: 787641 - DNA, 453 bp, Homo sapiens
  misc_feature: NA.41.64.F09.1.454.light.4.nb
agggggaggttctttctctgggatgtggcatgagcaaaactgacaagtcaaggcaggaagatgttgccatcacaactcattgggtttctgctgctctgggttccagtctccaggggtgaaattgtgctgactcaatctccagactttcagtctgtgactccaaaggagaaagtcaccatcacctgccgggccagtcagagcattggttatagcttacactggtaccagcagaaaccagatcagcctccaaagctcctcatcaagtatgcttcccagtccatctcaggggtcccctcgaggttcagtggcagtggatctgggacagatttcaccctcaccatcaatagcctggaagctgaagatgttgcaacgtattactgtcatcagagtagtactttacctcggaccttcggccaagggacacgactggagattaaacgaactgtggctgca

SEQ ID NO: 787642 - DNA, 480 bp, Homo sapiens
  misc_feature: NA.43.21.B10.1.454.light.4.nb
agagaggaggggaggctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgaactactcaca

SEQ ID NO: 787643 - DNA, 476 bp, Homo sapiens
  misc_feature: NA.5.36.D03.1.454.light.4.nb
atctctcttgggcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactagtgg

SEQ ID NO: 787644 - DNA, 468 bp, Homo sapiens
  misc_feature: NA.8.38.D05.1.454.light.4.nb
ttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcatcttcccg

SEQ ID NO: 787645 - DNA, 455 bp, Homo sapiens
  misc_feature: NA.48.10.A10.1.454.light.4.nb
agggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaagggaccacgggtggaaatacaaacgaactagtggctgcaccatctgtcttctatt

SEQ ID NO: 787646 - DNA, 468 bp, Homo sapiens
  misc_feature: NA.10.71.G05.1.454.light.4.nb
agagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcatcttccccg

SEQ ID NO: 787647 - DNA, 446 bp, Homo sapiens
  misc_feature: NA.47.67.G01.1.454.light.4.nb
ttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaa

SEQ ID NO: 787648 - DNA, 439 bp, Homo sapiens
  misc_feature: NA.7.67.G01.1.454.light.4.nb
ttgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagcctccctggccatcactgggctccaggctgaggatgaggctgattattactgccagtcgtatgacagcagcctgagtgtttgggtgttcggcggagggaacc

SEQ ID NO: 787649 - DNA, 456 bp, Homo sapiens
  misc_feature: NA.9.39.D06.1.454.light.4.nb
cagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaagagccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccatcagcagtctgcagtcggaagattttgcagtttactattgtcagcagtatagtaacgggccgctcactttcggcggagggaccaaggtggagatcaaacgaactgtggctgcaccatctgtcttcta

SEQ ID NO: 787650 - DNA, 440 bp, Homo sapiens
  misc_feature: NA.41.76.G10.1.454.light.4.nb
agggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgtcgggccagtcagagtattagtggctggttggcctggtatcagcagacaccagggaaagcccctaagctcctgatccataaggcatctaatttagaaagtggggtcccatcaaggttcagcggcagtggatctgggacagaattcactctcaccatcagcagcctgcagcctgatgattttgcaacttattactgccagcaatatcatagttctccttggacgttcggccaagggaccaaggtggacgatcaaacgaactagtggctgcacc

SEQ ID NO: 787651 - DNA, 493 bp, Homo sapiens
  misc_feature: NA.7.21.B10.1.454.light.4.nb
agagaggaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtcttcatcttcccgccatctgatagagacacg

SEQ ID NO: 787652 - DNA, 470 bp, Homo sapiens
  misc_feature: NA.9.37.D04.1.454.light.4.nb
ttgggtttggggggtgtggtggtgcctcagccatggcctggaccgttctcctcctcggcctcctctctcactgcacaggctctgtgacctcctacgtgctgactcagccaccctcggtgtcagtggccccaggaaagacggccaccattacgtgtgggggatacaacattggaagtaaaagtgttcactggtaccagcagaagccaggccaggcccctgtgttggtcgtctatgatgatacagaccggccctcagggatccctgagcgattctctggctccaattctggtgacacggccaccctgatcatcagcagggtcgaggtcgaggatgaggccgactattactgtcaggtgtgggatagtggtactgatcattgggtgttcggcggagggaccaagctgaccgtcctaggtcagcccaaggctgccccctcggtcactctgttcccaccctcctcagacgtatca

SEQ ID NO: 787653 - DNA, 457 bp, Homo sapiens
  misc_feature: NA.3.35.D02.1.454.light.4.nb
ttgggtttggggtgatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaagctacacactggccgtacacttttggccaggggaccaagctggagatcaaacgaactgtggctgcacca

SEQ ID NO: 787654 - DNA, 447 bp, Homo sapiens
  misc_feature: NA.17.57.F02.1.454.light.4.nb
ttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagcaactttttaaattggtatcagcgggaaccagggaaagcccctaaactcctgatctatactgcatccaatttgcaaagtggggtcccatcaaggttcagtggcagtggatctgggacagatttcactctcaccatcagcagtctgcaacctgaggattttgcaacttactactgtcaacagggttacagtaccccgtacacttttggccaggggaccaagctggagatcaaacgaactgtggctgcaccat

SEQ ID NO: 787655 - DNA, 458 bp, Homo sapiens
  misc_feature: NA.40.65.F10.1.454.light.4.nb
agggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccg

SEQ ID NO: 787656 - DNA, 443 bp, Homo sapiens
  misc_feature: NA.41.80.H03.1.454.light.4.nb
aagggaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaagg

SEQ ID NO: 787657 - DNA, 447 bp, Homo sapiens
  misc_feature: NA.9.76.G10.1.454.light.4.nb
aggggtcagctgcgggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctcccgggaaaggctcccaaactcctcatctattatgatgatctgctgccctcaggggtctctgaccgattctctggctccaagtctggcacctcagcctccctggccatcagtgggctccagtctgaggatgaggctgattattactgtggagcatgggatgacagcctgaatgcttggatgttcggcggagggaccaagctgaccgtcctaggtcagcccaac

SEQ ID NO: 787658 - DNA, 469 bp, Homo sapiens
  misc_feature: NA.48.48.E04.1.454.light.4.nb
agagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 787659 - DNA, 440 bp, Homo sapiens
  misc_feature: NA.14.11.A11.1.454.light.4.nb
agggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtcccatcaaggttcagcggcagtggatctggcacagatttcactctcaccatcagcagcctgcagcctgaagattttgcaacttattactgtctacaagattacaattaccctcgaacgttcggccaagggaccaaggtggaagtcaaacgaactgtggctgcaccat

SEQ ID NO: 787660 - DNA, 481 bp, Homo sapiens
  misc_feature: NA.19.59.F04.1.454.light.4.nb
tagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttccccacctcctccacg

SEQ ID NO: 787661 - DNA, 467 bp, Homo sapiens
  misc_feature: NA.9.55.E11.1.454.light.4.nb
ttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatgcgggggtgttcggcggagggaccaagctgaccgtcctaagtcagcccaaggctgccccctcggtcactctcg

SEQ ID NO: 787662 - DNA, 419 bp, Homo sapiens
  misc_feature: NA.17.67.G01.1.454.light.4.nb
ttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcacagcattagcagctatttaaattggtatcagcagaaaccagggagagcccctaacctcctgatctatgctgcatccagtttgcagagtggggtcccatcaaggttcagtggcagtggatctgggacagatttcactctcaccatcagcagtctgcaacctgaagattttgcaacttactactgtcaacagagtctcagtaccccccggacgttcggccgagggaccgacgggt

SEQ ID NO: 787663 - DNA, 490 bp, Homo sapiens
  misc_feature: NA.48.74.G08.1.454.light.4.nb
aggggagcttcagctgtggtagagaagacaggattcaggacaatctccagcatggccggcttccctctcctcctcaccctcctcactcactgtacagggtcctgggcccagtctgtgctgactcagccaccctcagcgtctgggacccccggacagagggtcaccatctcttgttctggaagcagttccaacatcggaagtaattctgtattctggtaccagcagctcccaggatcggcccccaaattgctcatctatatgaataatcaacggccctttggggtccctgaccgattctctggctccaagtctgacacctcagcctccctggccatcagtgggctccggtccgaggatgaggctgattattactgtgcagcatgggatgacagtcatgtgcttttcggcggagggaccaaggtgaccgtcctaggtcagcccaaggctgccccctcggtcactctgttcccgccctcctctatgtatactc

SEQ ID NO: 787664 - DNA, 480 bp, Homo sapiens
  misc_feature: NA.17.42.D09.1.454.light.4.nb
agggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccct

SEQ ID NO: 787665 - DNA, 449 bp, Homo sapiens
  misc_feature: NA.52.45.E01.1.454.light.4.nb
tctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttttgatgtacactggtaccagcagcttccgggaacagcccccaaactcctcatctttggtaacagcaatcggccctccggggtccctgaccgattctctggctccaagtctggcacctcagcctccctggccatcactgggctccaggctgaggatgaggctgattattactgccagtcctatgacagcagcctgagtgtcttttgggtcttcggaactgggaccaaggtcaccgtcctaggtcacg

SEQ ID NO: 787666 - DNA, 474 bp, Homo sapiens
  misc_feature: NA.8.43.D10.1.454.light.4.nb
agggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctccttggggccaaagctgccctgacactgtcaggtgtgcagcctgaggacgaggctgagtattactgcctgctctattatggtgggccttgggtgttcggcggagggaccaagctgaccgtcctaggtcagcccaaggctgccccctcggtcactctgttcccaccctcctcgacacgcg

SEQ ID NO: 787667 - DNA, 479 bp, Homo sapiens
  misc_feature: NA.48.22.B11.1.454.light.4.nb
agggggcagggagtcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctgaagatgttgcaacttattactgtcaacagcttagtagtaaccctccgtacacttttggccaggggaccaaggtggagatcaaacgaactgtggctgcaccatctgtcttcatcttcccgccatctgatatgtatact

SEQ ID NO: 787668 - DNA, 442 bp, Homo sapiens
  misc_feature: NA.15.8.A08.1.454.light.4.nb
agggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctgtcttcatcttcccgccatctgagctacgt

SEQ ID NO: 787669 - DNA, 444 bp, Homo sapiens
  misc_feature: NA.53.85.H08.1.454.light.4.nb
tcgcgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcacgttatgatgtacactggtaccagcaccttccaggagcagcccccaacctcctcctctctggtaacaccaatcggccctcaggggtccctgaccgattctctggctcgaagtctggcacctcagcctccctggccatcactggcctccaggctgaggatgaggctgattattactgccagtcctatgacagcagcctgaatgcttatgtcttcggaactgggaccaaggtcaccg

SEQ ID NO: 787670 - DNA, 473 bp, Homo sapiens
  misc_feature: NA.15.76.G10.1.454.light.4.nb
aggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcctcgctacg

SEQ ID NO: 787671 - DNA, 462 bp, Homo sapiens
  misc_feature: NA.52.51.E07.1.454.light.4.nb
agctacaacaggcaggcaggggcagcaagatggtgttgcagacccaggtcttcatttctctgttgctctggatctctggtgtctacggggacttcgtgctgacccagtctccagactccctggctgtgtctctgggcgcgagggccaccatcaactgcaagtccagccggagtgttttctggcgccccaccgataagaactacttagcttggtatcagcacaaaccaggacaccctcccaaactcctcatttcctgggcatctacccgggaatccggggtccctgaccgattcagtggcagcgggtctgagacggatttcactctcaccatcagcagcctgcaggctgaagatgtggcagtgtattactgtcagcagtatgctggtactccctacacttttggccaggggaccaaggtggagatcaaacgaactgtggctgcaccatctgtcttcatcttcc

SEQ ID NO: 787672 - DNA, 463 bp, Homo sapiens
  misc_feature: NA.49.75.G09.1.454.light.4.nb
agggggagtcagtcccaaccaggacacagcatggacatgagggtccctgctcagctcctggggctcctgctgctctggctctcaagtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccaaggtggagatccagcgaactgtggctgcaccatctgtcttcatcttcccgccatctgatct

SEQ ID NO: 787673 - DNA, 427 bp, Homo sapiens
  misc_feature: NA.51.1.A01.1.454.light.4.nb
agggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttcactttcaccatcagcagactgcagcctgaagatattgcaacatattactgtcaacagtatgataatctcccgctcactttcggcggagggaccaaggtggggatcaaacgaactgtgg

SEQ ID NO: 787674 - DNA, 444 bp, Homo sapiens
  misc_feature: NA.5.42.D09.1.454.light.4.nb
agggaaagggggagtcagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagagttcactctcacaatcagcagcctgcagcctgatgatcttggaacttattactgccaacaatataatagttattggacgttcggccaggggacgaaggtcgaaatgagacgaactgtggctgcaccatctgtt

SEQ ID NO: 787675 - DNA, 497 bp, Homo sapiens
  misc_feature: NA.41.9.A09.1.454.light.4.nb
aggggcagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccgccctcctcatagtataga

SEQ ID NO: 787676 - DNA, 481 bp, Homo sapiens
  misc_feature: NA.47.53.E09.1.454.light.4.nb
ttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtgggagactaattttggtcatatgttgttcggcggagggaccaagctgaccgtcctcggtcagcccaaggctgccccctcggtcactctgttcccaccctcctctacg

SEQ ID NO: 787677 - DNA, 473 bp, Homo sapiens
  misc_feature: NA.52.23.C01.1.454.light.4.nb
tagggattggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggcggagggaccaaggtggagatcagacgaactgtggctgcaccatctgtcttcatcttcccgccatctgatatacg

SEQ ID NO: 787678 - DNA, 465 bp, Homo sapiens
  misc_feature: NA.43.62.F07.1.454.light.4.nb
aagggaaagggggcaggagtcagtctcagtcaggacacagcatggacatgagggtccccgctcagctcctggggctcctgctactctggctccgaggtgccagatgtgacatccagttgacgcagtctccatcctccctgtctgcatctgtgggagacagactcaccatcacttgccgggcaagtcagaccattaggacctatttaaattggtatcaggagaacccagggaaagcccctaagctcctgatctatgctacttccactttgcaaagtggggtcccatctaggttcagtggcagtggatcggggacacatttcactctcaccatcagtagtctgcaacctgaagattatgcaacttacttctgtcaacagagtgacagaaacccgtggacgttcggccaagggaccaaggtggaaagcaaacgaactgtggctgcaccatctgtcttcatcttccccg

SEQ ID NO: 787679 - DNA, 400 bp, Homo sapiens
  misc_feature: NA.5.53.E09.1.454.light.4.nb
ttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgacctt

SEQ ID NO: 787680 - DNA, 435 bp, Homo sapiens
  misc_feature: NA.12.39.D06.1.454.light.4.nb
cagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgctcccttttgtattggtttctgcagagaggcaggccagtctccacaactcctgatctatgaagttgccacccggctctctggagtgccagatatgttcagtggctgcgggtcaggcacagatctcacactgaaaaacagccgggtggagagtgaccatgttggaacttattactgcatgcaag

SEQ ID NO: 787681 - DNA, 463 bp, Homo sapiens
  misc_feature: NA.41.45.E01.1.454.light.4.nb
agcctagctgtggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcactcttc

SEQ ID NO: 787682 - DNA, 456 bp, Homo sapiens
  misc_feature: NA.22.14.B03.1.454.light.4.nb
tccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacca

SEQ ID NO: 787683 - DNA, 482 bp, Homo sapiens
  misc_feature: NA.43.5.A05.1.454.light.4.nb
agggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgctcgggttttcggcggagggaccaagttgaccgtcctaggtcagcccaaggctgccccctcggtcactctgttcccaccctcctcacta

SEQ ID NO: 787684 - DNA, 445 bp, Homo sapiens
  misc_feature: NA.47.62.F07.1.454.light.4.nb
aagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggaccaaagtggatatcaaacgaactgtggctgcaccatctgtt

SEQ ID NO: 787685 - DNA, 464 bp, Homo sapiens
  misc_feature: NA.22.21.B10.1.454.light.4.nb
aggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtcactctcg

SEQ ID NO: 787686 - DNA, 479 bp, Homo sapiens
  misc_feature: NA.51.15.B04.1.454.light.4.nb
tccgcgggggatcaggactcctcagttcaccttctcacatgaggctccctgctcagctcctggggctgctaatgctctgggtctctggatccagtggggatattgtgatgactcagtctccactctccctgcccgtcacccctggagagccggcctccatctcctgcaggtctagtcagagcctcctccatagtaatggattcagctatttggattggtacctgcagaggccagggcagtctccacagctcctgatctatttgggttctaatcgggcccccggggtccctgacaggttcagtggcagtggatcaggcacagattttacactgaaaatcagcagcgtggaggctgaggatgttggggtttattactgcatgcaagctctacaaactcctacgttcggccaagggaccaaggtggaaatcaaacgaactgtggctgcaccatctgtcttcatcttcccgccatctgatcgt

SEQ ID NO: 787687 - DNA, 474 bp, Homo sapiens
  misc_feature: NA.40.11.A11.1.454.light.4.nb
agggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactgtggctgcaccatctgtcttcatcttcccgccat

SEQ ID NO: 787688 - DNA, 454 bp, Homo sapiens
  misc_feature: NA.10.33.C11.1.454.light.4.nb
ttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaactgtggctgcaccatctgtcttcatt

SEQ ID NO: 787689 - DNA, 445 bp, Homo sapiens
  misc_feature: NA.17.39.D06.1.454.light.4.nb
cagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccaagggaccaaggtggaaatcaaacgaactgtggctgca

SEQ ID NO: 787690 - DNA, 455 bp, Homo sapiens
  misc_feature: NA.15.58.F03.1.454.light.4.nb
aagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcacagcaactggttactctctttcggcggagggaccaaggtggagatcaaacgaactgtggctgcaccatctgtcttcta

SEQ ID NO: 787691 - DNA, 400 bp, Homo sapiens
  misc_feature: NA.11.3.A03.1.454.light.4.nb
agggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 787692 - DNA, 476 bp, Homo sapiens
  misc_feature: NA.43.66.F11.1.454.light.4.nb
agggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgaactactcaca

SEQ ID NO: 787693 - DNA, 433 bp, Homo sapiens
  misc_feature: NA.5.15.B04.1.454.light.4.nb
tccgcgggggtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggccaagggaccaaggtggaaatcaaacgaactgtggctgcacc

SEQ ID NO: 787694 - DNA, 447 bp, Homo sapiens
  misc_feature: NA.52.22.B11.1.454.light.4.nb
agggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcagctatttaaattggtatcaacataccccggggaaggcccctaagttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcatt

SEQ ID NO: 787695 - DNA, 454 bp, Homo sapiens
  misc_feature: NA.12.23.C01.1.454.light.4.nb
tagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccaaggtggagatcaaacgaactgtggctgcaccatctgtctt

SEQ ID NO: 787696 - DNA, 501 bp, Homo sapiens
  misc_feature: NA.49.65.F10.1.454.light.4.nb
agggcacgaccggtgctcgatttagctacgctctaaggggctgggcctaaggaagcagcactggtggtgcctcagccatggcctggaccgttctcctcctcggcctcctctctcactgcacagtctctgtgacctcctatgtgctgtctcagtcaccctcggtgtcagtggccccaggacagacggccaggattacctgtgggggagacaacattggaaataaaggtgtgcactggtaccagcagatgccaggccaggcccctgtcctggtcgtctttgatgatagcgaccggccctcagggatccctgagcgattctctggctccaactctggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccct

SEQ ID NO: 787697 - DNA, 454 bp, Homo sapiens
  misc_feature: NA.51.21.B10.1.454.light.4.nb
agagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcta

SEQ ID NO: 787698 - DNA, 489 bp, Homo sapiens
  misc_feature: NA.49.21.B10.1.454.light.4.nb
agggggctggggtctcaggaggcagcgctcgcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggtgttcggcggagggaccaagctgaccgtcctaggtcagcccaaggctgccccctcggtcactctgttcccaccctcctctctctcgta

SEQ ID NO: 787699 - DNA, 451 bp, Homo sapiens
  misc_feature: NA.3.14.B03.1.454.light.4.nb
tccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccatctcctgcagggccagtcagactattagaagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcactttatttctgtcagcagtataataactggcctccgtggacgttcggccggggaccaaggtggagatcaaacgaactgtggctgcaccatctgtctt

SEQ ID NO: 787700 - DNA, 472 bp, Homo sapiens
  misc_feature: NA.40.46.E02.1.454.light.4.nb
agtctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcactctgttcccaccctcctcagtcgctaga

SEQ ID NO: 787701 - DNA, 484 bp, Homo sapiens
  misc_feature: NA.19.71.G05.1.454.light.4.nb
tgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgcaccatctgtcttcatcttcccgccatctgacacgagagta

SEQ ID NO: 787702 - DNA, 469 bp, Homo sapiens
  misc_feature: NA.40.16.B05.1.454.light.4.nb
aggggggggtctcaggaggcagcactctcgggacgtctccaccatggcctgggctctgctcctcctcagcctcctcactcagggcacaggatcctggactcagtctgccctgactcagcctcgctcagtgtccgggtctcctggacagtcagtcaccctctcctgcactggaaccagcagtaatgttggtggttataactttgtctcctggtaccaacaccacccaggcaaagcccccaaattcttgatttatgatgtcaataagcggccctcaggggtccctgatcgcttctctggctccaagtctggcaacacggcctccctgaccatctctgggctccaggctgaggatgaggctgattattactgctgctcatttgcaggtagtttttgggtgttcggcggagggaccaagctgaccgtcctaggtcagcccaaggctgccccctcggtcactctgttcccacct

SEQ ID NO: 787703 - DNA, 486 bp, Homo sapiens
  misc_feature: NA.40.22.B11.1.454.light.4.nb
agggcacgaccggtgctcgatttagacgacagctcagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcagtggatcaggtacagattttacactgaaaatcagcagagtggaggctgaggatgttggggtttattactgcatgcaagctctacaaattcctcggacgttcggccaagggaccaaggtggaaatcaaacgaactagtggctgcaccat

SEQ ID NO: 787704 - DNA, 447 bp, Homo sapiens
  misc_feature: NA.3.77.G11.1.454.light.4.nb
aagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcactggtctcccaggcaggttcagtggcagtggatctgggacagaattcacgctcaccatcatcaggctgcggtctgacgacttcgcagtctatttctgtcaacagtacgatggccggcctccgtggacattcggccaaggtaccaaggtggacatcagacgaactgtggctgcaccat

SEQ ID NO: 787705 - DNA, 478 bp, Homo sapiens
  misc_feature: NA.4.29.C07.1.454.light.4.nb
agggaaagggggaaagctgctcagttaggacccagagggaaccatggaaaccccagcgcagcttctcttcctcctgctactctggctccctgatgccaccggagaaattgtgttgacgcagtctccagccaccctgtctttgtctccaggggaaagagccaccctctcctgcagggccagtcagaatgttagcagcagattcttagcctggtatcagcagagacgtggccaggctcccaggctcatcatctatggtgcatccagcagggccactggcatcccagacaggttcagtggcagtgggtctgggacagacttcactctcaccatcagcgacctggagcctgaagattttgcagtgtattactgtcagcagtatggtagcgcacggacgttcggccaaggggccagggtggaaatcaaacgaactgtggctgcaccatctgtcttcatcttcccgccatctgactacagtgct

SEQ ID NO: 787706 - DNA, 515 bp, Homo sapiens
  misc_feature: NA.48.19.B08.1.454.light.4.nb
agggagaagggcttgatgccttggggtgggaggagagacccctcccctgggatcctgcagctctagtctcccgtggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccaa

SEQ ID NO: 787707 - DNA, 438 bp, Homo sapiens
  misc_feature: NA.13.6.A06.1.454.light.4.nb
agggcagactgagcccaggatcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctccctgaccatctctgggctccaggctgaggatgagtctgattattactgctgctcatatgcaggcagctacactgtactattcggcggagggaccaagctgaccgtcctaggtcagcccaaggctgccccctcggtcactctcg

SEQ ID NO: 787708 - DNA, 470 bp, Homo sapiens
  misc_feature: NA.51.10.A10.1.454.light.4.nb
aggggcagcttcagctgtgggtagagaagacaggactcaggacaatctccagcatggccagcttccctctcctcctcaccctcctcactcactgtgcagggtcctgggcccaatctgtgctgactcagccaccctcagcgtctgggacccccgggcagagggtcaccatctcctgttctggaagcaactccaacatcggaagttatactgcagactggtaccagcaactcccaggatcggcccccaaactcctcatctatactactaatcaacgggccacaggggtccctgaccgattctccggctccaagtctggcacctcagcctccctggccatcagtggtctccagtctgaggatgaggctcaatacttctgtgcatcatgggatgacagtttgaatggtccggtgttcggcggagggaccaaactgaccgtccttagtcagcccaaggctgccccctcggtcact

SEQ ID NO: 787709 - DNA, 474 bp, Homo sapiens
  misc_feature: NA.48.71.G05.1.454.light.4.nb
agagaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttcccgccatctgatatgtatact

SEQ ID NO: 787710 - DNA, 459 bp, Homo sapiens
  misc_feature: NA.51.76.G10.1.454.light.4.nb
aggggagagctctggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgtggctgcaccatctgtctt

SEQ ID NO: 787711 - DNA, 451 bp, Homo sapiens
  misc_feature: NA.49.64.F09.1.454.light.4.nb
agggggcagggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaaagaactgtggctgcaccatctgtcttcta

SEQ ID NO: 787712 - DNA, 479 bp, Homo sapiens
  misc_feature: NA.48.17.B06.1.454.light.4.nb
agggggctggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctgccccctcggtcactctgttcccaccct

SEQ ID NO: 787713 - DNA, 483 bp, Homo sapiens
  misc_feature: NA.40.78.H01.1.454.light.4.nb
aaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtcctaggtcagcccaaggctgccccctcggt

SEQ ID NO: 787714 - DNA, 459 bp, Homo sapiens
  misc_feature: NA.16.38.D05.1.454.light.4.nb
ttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaaacctggccaggctcccaggctcctcatctatggtgcatctaccagggccactgatgtcccaggccggttcagtggcagtgggtttgggacagacttcactctcaccatcagcaccctgcagtctgaggattttgcaatttattattgtcagcagtataattactggcctccgtacacttttggccaggggaccaagctggagatcaaacgaactgtggctgcaccatctgtcttcatt

SEQ ID NO: 787715 - DNA, 453 bp, Homo sapiens
  misc_feature: NA.41.23.C01.1.454.light.4.nb
tagggattgctgtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagggaccaagctgaccgtccttggtcagcccaaggctgccccctcggt

SEQ ID NO: 787716 - DNA, 443 bp, Homo sapiens
  misc_feature: NA.10.35.D02.1.454.light.4.nb
ttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcacc

SEQ ID NO: 787717 - DNA, 469 bp, Homo sapiens
  misc_feature: NA.27.78.H01.1.454.light.4.nb
atcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatcc

SEQ ID NO: 787718 - DNA, 497 bp, Homo sapiens
  misc_feature: NA.3.4.A04.1.454.light.4.nb
agggcacgaccggtgctcgatttagagtagtgatcaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcggccacgggaccgaaggtggaaatcaaacgaactgtggctgcaccatctgtcttcta

SEQ ID NO: 787719 - DNA, 483 bp, Homo sapiens
  misc_feature: NA.17.34.D01.1.454.light.4.nb
gatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcaccatctgtcttcatcttcccgccatctgactagtctacg

SEQ ID NO: 787720 - DNA, 462 bp, Homo sapiens
  misc_feature: NA.3.53.E09.1.454.light.4.nb
ttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaaaaagaactacttaggttggtaccagcagaaaccagggcagcctcctaagctgctcattacctgggcatctacccgggaatctggggtccctgaccgattcagtggcagcgggtctgggacagatttcactctcaccatcaccaacctgcaggctgaagatgtggccgtttatactgtcagcaatattatggtactcctccgtggacgttcggccaagggaccaaggtggaaatcaaacgaactgtggctgcaccat

SEQ ID NO: 787721 - DNA, 463 bp, Homo sapiens
  misc_feature: NA.8.24.C02.1.454.light.4.nb
tagggaaaggggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagcaccccggcagagcccccaaactcatcatttatgatgtcactgatcgcccctcaggggtttcgaatcgcttctctggctccaagtctggcaacacggcctccctgaccatctctgggctccaggctgaggacgaggctcattattattgcagttcatatacgaccagcagcactctcgtggtcttcggcggagggaccaagttgaccgtcctaagtcagcccaaggctgccccctc

SEQ ID NO: 787722 - DNA, 466 bp, Homo sapiens
  misc_feature: NA.4.10.A10.1.454.light.4.nb
aggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctgccccctcggtcactctgttcccgt

SEQ ID NO: 787723 - DNA, 463 bp, Homo sapiens
  misc_feature: NA.52.36.D03.1.454.light.4.nb
atctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgaccgtcctacgtcagcccaaggctgccccctcggtcactctgttccccg

SEQ ID NO: 787724 - DNA, 513 bp, Homo sapiens
  misc_feature: NA.47.82.H05.1.454.light.4.nb
tagaagtcacttatgagacacaccagtgtggccttgttggcttgaagctcctcaggaagcagcatcgggggtgccgcagccatggcctggaccgctctccttctgagcctccttgctcactttacagtttctgtggcctcctttgacctgactcagccactctcagtgtccgtggccctgggacagacggccagacttacctgtgggggaatcaacattggacgtaaaaatgtgcactggtaccaacagaagccaggccaggcccctgtcctggtcatctataaggatacaaaccggccctctgggatccctgaacgattctctggctccaattcggacaacacggccaccctgaccatcagcagagcccaagtcggagatgaggctgactatttctgtcaaatttgggacatctccgctgcggtattcggcgcagggaccaagctgaccgtcctaagtcagcccaaggctgccccctcggtcactctgttcccaccctcctctacgtgagct

SEQ ID NO: 787725 - DNA, 453 bp, Homo sapiens
  misc_feature: NA.53.31.C09.1.454.light.4.nb
agcctagctgtgctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctc

SEQ ID NO: 787726 - DNA, 363 bp, Homo sapiens
  misc_feature: NA.4.35.D02.1.454.light.4.nb
ttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgtcactctgttcccaccctcctcctacagtgct

SEQ ID NO: 787727 - DNA, 452 bp, Homo sapiens
  misc_feature: NA.41.44.D11.1.454.light.4.nb
aggggactgcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagtcatctctggggtccagtttgtggatgaggctgactactattgcacggtctggtacagcagcgctgtggtcttcggcggagggactgaacttatcgtcctaggtcagcccaaggctcg

SEQ ID NO: 787728 - DNA, 494 bp, Homo sapiens
  misc_feature: NA.47.85.H08.1.454.light.4.nb
tcggcgggggctgggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccgaccctcctctacgtgagct

SEQ ID NO: 787729 - DNA, 440 bp, Homo sapiens
  misc_feature: NA.51.20.B09.1.454.light.4.nb
gggaaaggggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcgggacagggtatgatgtacactggtaccagcagcttccaggaacagcccccaaactcctcatttattctaacacccatcggccctcaggggtccctgatcgattctctggctccaagtctggcacctcagcctccctggccatcactggactccaggctgaggatgaggctgattattactgccagtcctatgacatcagcctgagtggttcgtgggtattcggcggagggacc

SEQ ID NO: 787730 - DNA, 474 bp, Homo sapiens
  misc_feature: NA.16.88.H11.1.454.light.4.nb
aacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccct

SEQ ID NO: 787731 - DNA, 497 bp, Homo sapiens
  misc_feature: NA.21.87.H10.1.454.light.4.nb
ttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggcgggacccagatgactgtcctcagtcagcccaaggctgccccctcggtcactctgttcccaccctcctccgagcgacga

SEQ ID NO: 787732 - DNA, 511 bp, Homo sapiens
  misc_feature: NA.15.34.D01.1.454.light.4.nb
ggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctgttcccaccctcctcgctacgtaga

SEQ ID NO: 787733 - DNA, 475 bp, Homo sapiens
  misc_feature: NA.5.14.B03.1.454.light.4.nb
tccgcgggggagtcagacccagtcaggacacagcatggacatgagggtccccgctcagctcctggggctcctgctgctctggttcccaggttccagatgcgacatccagatgacccagtctccttctttcgtttctgcatctgtaggagacagacttactctcacttgtcgggcgagtcacgatattagtaccaggttagcctggtatcagcagaagccagggaaagcccctaaactcctgatctatgctgcatccagtttgcaaagtggggtcccatcgaggttcagcggcagtggatctgggacagatttcactctcaccatcagcaggctgcagcccgaagattttgcaacttactattgtcaaaatactaacagtctcccgcgcagttttggccaggggaccaaagtggagatcaaacgaactgtggctgcaccatctgtcttcatcttcccgccatctgacgtgtctgat

SEQ ID NO: 787734 - DNA, 455 bp, Homo sapiens
  misc_feature: NA.52.42.D09.1.454.light.4.nb
agggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactc

SEQ ID NO: 787735 - DNA, 464 bp, Homo sapiens
  misc_feature: NA.43.10.A10.1.454.light.4.nb
aggggagctgtgggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcaaatactattatgccagctggtaccagcagaaaccaagacaggcccctatacttgtcatctatggtaaaaacaaccgaccctcagggatcccagaccgattctctggctccagctcaggcaacacagcttccttgaccatcactggggctcaggcggaagatgaggctgactattactgtaactcccgggacagcaatggtgacctatatgtcttcggaactgggaccaaggtcaccgtcctaggtcagcccaaggccaaccccactgtcactctgttccc

SEQ ID NO: 787736 - DNA, 460 bp, Homo sapiens
  misc_feature: NA.43.69.G03.1.454.light.4.nb
agcctagctgtggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcactc

SEQ ID NO: 787737 - DNA, 453 bp, Homo sapiens
  misc_feature: NA.21.27.C05.1.454.light.4.nb
agggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggacgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccaaggtggaaatcaaacgaactgtggctgcaccatctgtctt

SEQ ID NO: 787738 - DNA, 435 bp, Homo sapiens
  misc_feature: NA.52.14.B03.1.454.light.4.nb
gtgggtccaggaggcagaactctgggtgtctcaccatggcctggatccctctacttctccccctcctcactctctgcacaggctctgttgcctcctatgagctgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccc

SEQ ID NO: 787739 - DNA, 475 bp, Homo sapiens
  misc_feature: NA.8.42.D09.1.454.light.4.nb
agggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccaccctcctcg

SEQ ID NO: 787740 - DNA, 445 bp, Homo sapiens
  misc_feature: NA.48.79.H02.1.454.light.4.nb
agggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggtccaagggaccgaacggtaggaaagtacaaacg

SEQ ID NO: 787741 - DNA, 466 bp, Homo sapiens
  misc_feature: NA.19.85.H08.1.454.light.4.nb
tcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtcactc

SEQ ID NO: 787742 - DNA, 401 bp, Homo sapiens
  misc_feature: NA.10.40.D07.1.454.light.4.nb
taacaacagagggggggggtgagggatgagaacctatgaacattctgtaggggtcaccatctcctgcactgggaacaacttcaacatcggggcagcttacgatgtccactggtatcgccaacttccaggcacagcccccaaaatcgtcttctatggtgacttcaatcggccctcaggggtccctgaccgcttctctggcttcaagtctggcacgtatgacacgtcccatttcctggccatcaatgggctccaggctgaagatgaggctgattactactgccagtcgtatgacaccaagctgaaactttgggtcttcggcggagggaccaggctgaccgtcctacgtcagcccaaggctgccccctcggtcactctcgttcccaccctcctccactactatg

SEQ ID NO: 787743 - DNA, 445 bp, Homo sapiens
  misc_feature: NA.52.44.D11.1.454.light.4.nb
agggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgctctggaaccagcagtgatgttggtaactataactctgtctcctggtaccaacagcacccaggcaaagccccccaactcataattcatgatgtcactaagcggccctcaggggtccctggtcgtttctctgcctccaagtctggcaacacggcctccctgaccatctctgggctccaggctgaggatgaggctgattattactgctgctcatatgcaggcagcaacacttatgtcttcggaactgggaccaaggtcaccgtcctaggtcagcccaac

SEQ ID NO: 787744 - DNA, 449 bp, Homo sapiens
  misc_feature: NA.10.59.F04.1.454.light.4.nb
tagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggcggtaccgcttgggtgttcggcggagggaccaagctgaccgtcctaggtcagaccccg

SEQ ID NO: 787745 - DNA, 455 bp, Homo sapiens
  misc_feature: NA.49.86.H09.1.454.light.4.nb
ttgggtttggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagcgttacaactggcctcccatgtacacttttggccaggggaccaagctggaaatcagacgaactgtggctgcaccatctgtt

SEQ ID NO: 787746 - DNA, 451 bp, Homo sapiens
  misc_feature: NA.51.25.C03.1.454.light.4.nb
agtcagtctcagtcgggacacagcatggacatgagggtccccgctcagctcctggggctcctgctactctggctccgaggtgccagatgtgacatccagatgacccagtctccatcctccctgtctgcatctataggagacagagtcacaatcccttgccggtcaagtcaaaacattagcaactatttaaattggtatcaacagaaaccagggaaagcccctaacctcctgatctatgctgcttccactttgcaaagtggggtcccatcgaggttcagtggcagtggatctgggacagatttcagtctcaccatcaccaatctgcgacctgaagattttgcaacttattattgtcaacaggcttacatcacccctctcactttcggcggagggaccaaggtggagatcaaacgaactgtggctgcaccatctgtcttcatcttcccgccat

SEQ ID NO: 787747 - DNA, 492 bp, Homo sapiens
  misc_feature: NA.51.9.A09.1.454.light.4.nb
aggggactgcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattcggcggggggaccaaactgaccgtcctaggtcagcccaaggctgccccctcggtcactctgttcccaccctcctctcgtagcact

SEQ ID NO: 787748 - DNA, 472 bp, Homo sapiens
  misc_feature: NA.53.79.H02.1.454.light.4.nb
agggaaaggggggggtcacaagaggcagcgctctcgggacgtctccaccatggcctgggctctgctgctcctcaccctcctcactcaggacacagggtcctgggcccagtctgccctgactcagcctgcctccgtctctgggtctcctggacagtcgatcaccatttcctgcactggaaccagcagtgatgttgggaattataaccttgtctcctggtaccaacaatacccaggcaaagcccccaaagtcataatttttgaggtcaataagcggccctctggggtttctgatcgcttctccggctccaagtctggcaacacggcctccctgacaatctctgggctccaggctgacgacgaggctgattattactgctgctcatatgcaggtaatcgtcgtttcgctgtgttcggaggaggcacccagctgaccgtcctcggtcagcccaaggctgccccctcggtcactctc

SEQ ID NO: 787749 - DNA, 438 bp, Homo sapiens
  misc_feature: NA.21.14.B03.1.454.light.4.nb
tccgcgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgttgcatccagtttgcaaagtgggtcccatcaaggttcagtggcagtggatctgggacagatttcactctcaccatcagcagtctgcaacctgaagattttgcaacttactactgtcaacagagttacagtaccccgtacactttaggccaggggaccaagctggagatcaaacgaactgtggctgcacca

SEQ ID NO: 787750 - DNA, 442 bp, Homo sapiens
  misc_feature: NA.4.12.B01.1.454.light.4.nb
tccgcgggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgtaacttactattgtcagagttctaattctttcccgcgcacgtttggccaggggaccaaggtagagatcaaacgaactgtggctgcaccatct

SEQ ID NO: 787751 - DNA, 496 bp, Homo sapiens
  misc_feature: NA.10.27.C05.1.454.light.4.nb
agggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgccccctcggtcactctgttcccaccctcctccactactatg

SEQ ID NO: 787752 - DNA, 484 bp, Homo sapiens
  misc_feature: NA.4.61.F06.1.454.light.4.nb
tcagagctctggagaagagctgctcagttaggacccagagggaaccatggaaaccccagcgcagcttctcttcctcctgctactctggctcccagatgccgccggagaagttgtgctgacgcagtctccaggcaccctgtctttgtctccaggggagagcgccaccctctcctgcaggcccagtgaggcggtaaggagcgattacttagcctggtatcagcagaaacctggccaggctcccaggctcctcatccagggtgcatccaacagggccacgggcatcccagccaggttcagtggccgtgcgtctgggacagtcttcactctcaccatcagcggactggagcctgaagattttgctgtgtatttttgtcagcagtatggcacatcaccggtcaccttcggccaagggtcacggctggagattaaacgaactgtggctgcaccatctgtcttcatcttcccgccatctgactacagtgct

SEQ ID NO: 787753 - DNA, 483 bp, Homo sapiens
  misc_feature: NA.22.57.F02.1.454.light.4.nb
ttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcattcttccccg

SEQ ID NO: 787754 - DNA, 508 bp, Homo sapiens
  misc_feature: NA.41.25.C03.1.454.light.4.nb
cacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttccca

SEQ ID NO: 787755 - DNA, 482 bp, Homo sapiens
  misc_feature: NA.41.5.A05.1.454.light.4.nb
agggcacgaccggtgctcgatttagatagatagacagggggcaggagtcagacccagtcaggacacagcatggacatgagggtccccgctcagctcctggggctcctgctgctctggttcccaggttccagatgcgacatccagctgacccagtctccatcttctgtgtctgcatctgtaggagacagagtcaacatcacttgtcgggcgagtcagggtattaccagctggttagcctggtatcagcagaaaccagggaaagcccctaaactcctgatctatgctgcatccagtttgcaaagtggggtcccatcaagattcagaggcagtggatctgggacagatttcactctcactatcaacagcctgcagcctgaagattttgccacttactattgtcaacaggctgacagtttccccttcaccttcggccaagggacacgactggacattaaacgaactgtggctgcaccatctgtctt

SEQ ID NO: 787756 - DNA, 436 bp, Homo sapiens
  misc_feature: NA.49.46.E02.1.454.light.4.nb
aggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgt

SEQ ID NO: 787757 - DNA, 403 bp, Homo sapiens
  misc_feature: NA.5.9.A09.1.454.light.4.nb
agggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccaccctcctccgtgtctgat

SEQ ID NO: 787758 - DNA, 460 bp, Homo sapiens
  misc_feature: NA.17.86.H09.1.454.light.4.nb
ttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactgtaaccagcagtgaccttagtgcttataactatgtctcctggtaccaacagcacccaggcaaggtccccaaagccatgatttatgaggtcagtaatcggccctcaggggtttctaatcgcttctctggctccaagtctggcaacacggcctccctcaccatctctggactccagcctgaggacgaggctgattattactgcatctcatttgtaagcagtagccttgtgttattcggcggagggaccaagctgaccgtcctgggtcagcccaaggctgccccccg

SEQ ID NO: 787759 - DNA, 433 bp, Homo sapiens
  misc_feature: NA.47.78.H01.1.454.light.4.nb
aacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccaccctcctctacgtgagct

SEQ ID NO: 787760 - DNA, 456 bp, Homo sapiens
  misc_feature: NA.4.71.G05.1.454.light.4.nb
tgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtcactctgttcccccg

SEQ ID NO: 787761 - DNA, 440 bp, Homo sapiens
  misc_feature: NA.40.10.A10.1.454.light.4.nb
agggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtccagggaccgaaagtggatgtcaaccgaactgtggctgcacca

SEQ ID NO: 787762 - DNA, 452 bp, Homo sapiens
  misc_feature: NA.5.35.D02.1.454.light.4.nb
ttgggtttgggggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtcttcta

SEQ ID NO: 787763 - DNA, 515 bp, Homo sapiens
  misc_feature: NA.49.12.B01.1.454.light.4.nb
tccgcgggcacgaccggtgctcgatttagtagtgtagattcgcggggaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaactcctgatctacgatgcatccaatttggaaataggggtcccatcaaggttcagtggaagtggatctgggacagtattttactttcaccatcagcaacctgcagcctgaagatattgcaacatattactgtcaacaatatgataatctaccactcactttcggcggagggaccacggtggagatcaaacgaactgtggctgcaccatctgtcttcatcttcccgccatctgatctctcgact

SEQ ID NO: 787764 - DNA, 504 bp, Homo sapiens
  misc_feature: NA.43.19.B08.1.454.light.4.nb
agggggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccaccctcctcactact

SEQ ID NO: 787765 - DNA, 473 bp, Homo sapiens
  misc_feature: NA.41.68.G02.1.454.light.4.nb
cacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggagggaccaaggtggagatcaaacgaactgtggctgcaccat

SEQ ID NO: 787766 - DNA, 464 bp, Homo sapiens
  misc_feature: NA.12.86.H09.1.454.light.4.nb
ttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcatttccccg

SEQ ID NO: 787767 - DNA, 477 bp, Homo sapiens
  misc_feature: NA.51.81.H04.1.454.light.4.nb
aggcctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctgttccccg

SEQ ID NO: 787768 - DNA, 494 bp, Homo sapiens
  misc_feature: NA.51.79.H02.1.454.light.4.nb
agggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacacctacttgacttggtttcagcagaggcctggccaatctccaaggcgccttatttataaggtttctaatcgggactttggggtcccagacagattcagcggcagtgggtcacgcactcacttcacactgaaaatcagcagggtggaggctgaggatttaggggtttattactgcatgcaaggtacacactggcctccgtacacttttggccaggggaccaagctcgagatcaaacgaactgtggctgcaccatctgtcttcatcttcccgccatctgatcgtagcact

SEQ ID NO: 787769 - DNA, 475 bp, Homo sapiens
  misc_feature: NA.48.1.A01.1.454.light.4.nb
agggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcatcttcccgccatctgatatgtatact

SEQ ID NO: 787770 - DNA, 457 bp, Homo sapiens
  misc_feature: NA.47.38.D05.1.454.light.4.nb
ttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaactgtggctgca

SEQ ID NO: 787771 - DNA, 473 bp, Homo sapiens
  misc_feature: NA.47.23.C01.1.454.light.4.nb
tagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctgccccctcggtcactctgttccccg

SEQ ID NO: 787772 - DNA, 460 bp, Homo sapiens
  misc_feature: NA.2.49.E05.1.454.light.4.nb
aacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcctaggt

SEQ ID NO: 787773 - DNA, 477 bp, Homo sapiens
  misc_feature: NA.40.12.B01.1.454.light.4.nb
tccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgttcccgccct

SEQ ID NO: 787774 - DNA, 479 bp, Homo sapiens
  misc_feature: NA.43.75.G09.1.454.light.4.nb
agggaaagggggaggaatcagacccagtcaggacacagcatggacatgagagtcctcgctcagctcctggggctcctgctgctctgtttcccaggtgccagatgtgacatccagatgacccagtctccatcctcactgtctgcatctgtgggagacagggtcaccttcacttgtcgggcgagtcagcgcattagcaattatttagcctggtttcagcagaaaccagggaaagcccctcagtccctgatctatgctgcattcaatttgcatagtggcgtcccatcaagattcagcgccagtggatctgggatagctttcactctcaccatcgccagcctgcagcccgaagattttgcaacttattactgccaacagtatgatgattacccgtacacttttggccaggggaccaagctggagatcaatcgaactgtggctgcaccatctgtcttcatcttcccgccatctgaactactcac

SEQ ID NO: 787775 - DNA, 425 bp, Homo sapiens
  misc_feature: NA.40.76.G10.1.454.light.4.nb
agggggcagaagtctctctcagtcaggacacagcatggacatgagggtccctgctcagctcctgggactcctgctgctctggctcccagataccagatgtgacatccagatgacccagtctccatcttccctgtctgcgtctgtaggagacagagtcaccatcacttgccgggcgagtcaggacattggcatttatgtagcctggtataaggagacaccaggaaaagttcctcaactcctgatctatggtgcatccactctgcacttcggggtcccatctcggttcagcggcagcggatctgggacacatttcactctcaccatcagcagcctgcagcctgaagatgttgcagtttattactgtcaaaagtatgacactgtcccgctcactttcggcggagggaccaaggtggagatgaagggaa

SEQ ID NO: 787776 - DNA, 456 bp, Homo sapiens
  misc_feature: NA.52.78.H01.1.454.light.4.nb
ctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtcactctgttccc

SEQ ID NO: 787777 - DNA, 455 bp, Homo sapiens
  misc_feature: NA.53.11.A11.1.454.light.4.nb
agggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactctcg

SEQ ID NO: 787778 - DNA, 420 bp, Homo sapiens
  misc_feature: NA.41.15.B04.1.454.light.4.nb
tccgcgggcacgaccggtgctcgatttagacagtatatatccgcgggcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 787779 - DNA, 447 bp, Homo sapiens
  misc_feature: NA.7.75.G09.1.454.light.4.nb
agggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtggctgcaccatctgtctt

SEQ ID NO: 787780 - DNA, 471 bp, Homo sapiens
  misc_feature: NA.40.47.E03.1.454.light.4.nb
agagagaaggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccaagctgaccgtcctaggtcagcccaaggctgccccctcggtcactctcg

SEQ ID NO: 787781 - DNA, 422 bp, Homo sapiens
  misc_feature: NA.15.11.A11.1.454.light.4.nb
agggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctccctgggagcctcggtcaagctcacctgcactctgagcagtgggcacaccagctacgccatcgcatggcatcagcagcagccagagaagggccctcgctacttgatgaagcttaacactgatggcagccacaggtaagggggacgggatccctgatcgcttctcaggctccagctctggggctgagcgctacctcaccatctccagcctccagtctgaggatgaggctgactattactgtcagacctggggcactggcaatagtt

SEQ ID NO: 787782 - DNA, 444 bp, Homo sapiens
  misc_feature: NA.22.6.A06.1.454.light.4.nb
agggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagcccaaggctgccccccg

SEQ ID NO: 787783 - DNA, 448 bp, Homo sapiens
  misc_feature: NA.3.55.E11.1.454.light.4.nb
ttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgctaatttattactgtcagcagtataataactggtggacgttcggccaagggaccaaggtagaaatcaaacgaactgtggctgcaccatctgtt

SEQ ID NO: 787784 - DNA, 492 bp, Homo sapiens
  misc_feature: NA.52.15.B04.1.454.light.4.nb
tccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatacacaaacagaaacacttgggtgttcggcggcgggaccaaactgaccgtccttcgtcagcccaaggctgcccctcggtcactctgttccccgaccctcctctatacgatcg

SEQ ID NO: 787785 - DNA, 505 bp, Homo sapiens
  misc_feature: NA.22.87.H10.1.454.light.4.nb
ttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccagaaacagcccccaaactcctcatctatggtaacaacaatcggccctcaggggtccctgaccgattctctggctccaagtctggcatgtcagcctccctggccatcactgggctccaggctgaggatgaggctgattatttctgccagtcctatgacaacagcctgggtgccgtggtattcggcggagggaccaagctgaccgtcctaggtcagcccaaggctgccccctcggtcactctgttcccaccctcctcacgcgtatgt

SEQ ID NO: 787786 - DNA, 462 bp, Homo sapiens
  misc_feature: NA.43.58.F03.1.454.light.4.nb
aagggaaagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctaaccagcggctacgtggactgctttcagcagagaccaggggagggccccccgtttgtgatgcgagtgggcactggtgggattgtgggatccaagggggatggcatccctgaccgcttctcagtcttgggctcaggcctgaatcggcacctgaccatcaagaacatccaggaagagggtgagagtgactcccactgtggggcagaccatggcaggtgggagcaacttccgtgagggtgttcggcggagggaccaggctgaccgtcctacgtcagcccaaggctccg

SEQ ID NO: 787787 - DNA, 446 bp, Homo sapiens
  misc_feature: NA.46.38.D05.1.454.light.4.nb
ttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatacaaacgaactgtggctgcaccat

SEQ ID NO: 787788 - DNA, 482 bp, Homo sapiens
  misc_feature: NA.49.3.A03.1.454.light.4.nb
agggcacgaccggtgctcgatttagagagcgtcacaggggggaggaactgctcagttaggacccagacggaaccatggaagccccagcgcagcttctcttcctcctgctactctggctcccagataccactggagaaatagtgatgacgcagtctccagccactttgtctgtgtctccaggggagagagccactctctcctgcaggaccagtcagagtgttaataacaagttagcctggtaccagcagagacctggccaggctcccaggctcctcatctatgatgtgtctaccagggccactggtatcccagccaggttcagtggcagtgggtctggggcggagttcactctcaccatcagcagcctgcagtctgaagattttgcagtttattactgtcagcactctaatgactggcccctgtacacttttggcccggggaccaaggtggagatcaaacgaactgtggctgcaccatctgtt

SEQ ID NO: 787789 - DNA, 506 bp, Homo sapiens
  misc_feature: NA.51.36.D03.1.454.light.4.nb
atctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctgggagcagctccaacatcggaactaatactgtgaactggtaccagcaactcccaggaacggcccccaaactcctcatctacagtaatagtcagcggccctcaggggtccctgaccgattctctggctccaagtctggctcctcagcctccctggccatcagtgggctccagtctgaggatgaggctgattattactgtgcagcgtgggatggcagcctgaatggttatgtcttcggaatagggaccaaggtcaccgtcctaggtcagcccaaggccaaccccactgtcactctgttcccgccctcctctcgtagcact

SEQ ID NO: 787790 - DNA, 489 bp, Homo sapiens
  misc_feature: NA.9.86.H09.1.454.light.4.nb
ttgggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctgccccctcggtcactctgttcccaccctcctcagacgtatca

SEQ ID NO: 787791 - DNA, 475 bp, Homo sapiens
  misc_feature: NA.15.86.H09.1.454.light.4.nb
ttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccaccctcctcgctacgtagacg

SEQ ID NO: 787792 - DNA, 448 bp, Homo sapiens
  misc_feature: NA.47.60.F05.1.454.light.4.nb
gggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccatctgtt

SEQ ID NO: 787793 - DNA, 457 bp, Homo sapiens
  misc_feature: NA.10.17.B06.1.454.light.4.nb
agggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccgggggaccaagctggaaatcaagcgaactgtggctgcaccatctgtcttcattccccg

SEQ ID NO: 787794 - DNA, 440 bp, Homo sapiens
  misc_feature: NA.52.19.B08.1.454.light.4.nb
agggggcaggagtcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagcaaaaagtagggacagcccctaaactcctgatcctcgatgcatccactttggagacaggggtcccatcaaggttcagtggaagtggctctgggacagattttactttcaccatcagcaggctgcagcctgaagatgttgcaacatattactgtcaacagtataatcgtctcccgctcactttcggcgggggaccgaaggtggagatcaagcgaactgtggctgcaccat

SEQ ID NO: 787795 - DNA, 452 bp, Homo sapiens
  misc_feature: NA.10.77.G11.1.454.light.4.nb
aagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgctagtttattactgtcagcagcgtagcaactggcctcggacgttcggccaagggaccaaagtaggacatcaagcgaactgtggctgcaccatctgtt

SEQ ID NO: 787796 - DNA, 499 bp, Homo sapiens
  misc_feature: NA.2.42.D09.1.454.light.4.nb
aggggaaagggcacgaccggtgctcgatttagacacatacgcagggaaaggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtccagtattcggcggagggaccaagctgaccgtcctaggtcagcccaagg

SEQ ID NO: 787797 - DNA, 456 bp, Homo sapiens
  misc_feature: NA.43.83.H06.1.454.light.4.nb
tcgcgggggctgctcagttaggacccagagggaaccatggaaaccccagcgcagcttctcttcctcctgctactctggctcccagataccaccggagaaactgtgttgacgcagtctccaggcacgctgtctttgtctccaggggaaagagccaccctctcgtgtagggccagtcagagtgttatcaccgactccttagcctggtaccagcagaaacctggccaggctcccaggctcctcatatatggtgcatccagcaggatcactggcatcccagcgaggttcagtggccatgggtctgggacggagttcactctcaccatcagccgactggagcctgaagattttgcagtatattactgtcaacaatatggtagttctcctctcactttcggcggagggaccaaggtggaagtcaaacgaactgtggctgcaccatctgtcttcatcttcccg

SEQ ID NO: 787798 - DNA, 462 bp, Homo sapiens
  misc_feature: NA.11.66.F11.1.454.light.4.nb
agggggggaagcctgagaacacttagccttcatgagtgtccccaccatggcctggatgatgcttctcctcggactccttgcttttgggtcaggagtgcattctcagactgtggtgacccaggaggcatcgttctcagtgtcccctggagggacagtcacactcacttgtggtttgaaatatgggtcagtctctactgcctactaccccagttggtaccagcaggccccaggccagactccacgcacgctcatctataacacaaagactcgctcttctggggtccctgctcgcttctctggctccatccttgggaacaaagctgccctcaccatcacgggggcccaggcagatgatgaatctgtttattattgtgtgctttttatgggtcgtggcacttctgctgtgttcggaggaggcacccacgtgaccgtcctcggtcagcccatggctgccccatcggt

SEQ ID NO: 787799 - DNA, 445 bp, Homo sapiens
  misc_feature: NA.16.68.G02.1.454.light.4.nb
agtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatcttccccg

SEQ ID NO: 787800 - DNA, 466 bp, Homo sapiens
  misc_feature: NA.17.87.H10.1.454.light.4.nb
ttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggaggcaccaaggtgaccgtcctaggtcagcccaaggctgccccctcggtcta

SEQ ID NO: 787801 - DNA, 454 bp, Homo sapiens
  misc_feature: NA.10.60.F05.1.454.light.4.nb
gggaaaggggggggtctcaggaggcagcactctcgggacgtctccaccatggcctgggctctgctcctcctcagcctcctcactcagggcacaggatcttgggctcagtctgccctgactcagcctcgctcagtgtccgggtctcctggacagtcagttaccatctcctgcactggaacctccaatgatgttggtggttatatctatgtctcctggtaccaacaacacgcaggcaaagcccccgaagtcatgatttatgatgtcagtaagcggccctcaggggtccctgaccgcttctctggctccaagtctggcaacacggcctccctgaccatctctggcctccaggctgaggatgaggctgactattattgctgctcatatgcaggcggacctggttccgggtatgtcttcggaactgggaccacggtcaccgtcctaggtcagcccaagg

SEQ ID NO: 787802 - DNA, 466 bp, Homo sapiens
  misc_feature: NA.53.35.D02.1.454.light.4.nb
ttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaaactgaccgtcctaggtcagcccaaggctgccccctcggtcactctgtt

SEQ ID NO: 787803 - DNA, 450 bp, Homo sapiens
  misc_feature: NA.15.25.C03.1.454.light.4.nb
tgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactgtggctgcaccatctgt

SEQ ID NO: 787804 - DNA, 453 bp, Homo sapiens
  misc_feature: NA.51.69.G03.1.454.light.4.nb
aggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaccttatgatgtacactggtaccaacaacttccaggagcagcccccaaactcctcatctttggtaacaacaatcggccctcaggggtccctgaccgattctctggctccaggtctggcacctcagcctccctggccatcactgggctccaggctgaggatgagggtgattattactgccagtcctatgacagcggcctcagttatttggtggtgttcggcggagggaccaaggtgaccgtcctaagtcacg

SEQ ID NO: 787805 - DNA, 500 bp, Homo sapiens
  misc_feature: NA.53.62.F07.1.454.light.4.nb
aagggaaagggcacgaccggtgctcgatttagtagtcgcataaagggaaagggggtgggctcaggaggcagagctctgggaatctcgccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccaacagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaagctgaccgtcctaggtcagcccaaggctgccccctcggtcact

SEQ ID NO: 787806 - DNA, 475 bp, Homo sapiens
  misc_feature: NA.10.86.H09.1.454.light.4.nb
ttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccaccctcctccactactatg

SEQ ID NO: 787807 - DNA, 455 bp, Homo sapiens
  misc_feature: NA.9.59.F04.1.454.light.4.nb
tagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgctaacttactactgtcagcaggctaacaggctgcccccaaccttcggccaggggacacgactggagattaaacgaactgtggctgcaccatctgtctt

SEQ ID NO: 787808 - DNA, 478 bp, Homo sapiens
  misc_feature: NA.19.78.H01.1.454.light.4.nb
tcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttcccaccctcctccacgagagta

SEQ ID NO: 787809 - DNA, 480 bp, Homo sapiens
  misc_feature: NA.49.43.D10.1.454.light.4.nb
aggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggactcccgggcagagggtcaccatctcttgttctggaggcagctccaacatcggaagtaatgatgttaactggtaccaacaaattccagggacggcccccaatgtcttcatctttggtaatgatcagcggccctcaggggtccctgaccgattctctggctccaagtctggcacctcagcctccctggccatcagtgggctccagtctgaggatgaggctgattattactgtgcaacatgggatgacagcctgaatgccgtggttttcggcggagggaccaaggtgaccgtcctaggtcagcccaaggctgccccctcggtcactctgttcccg

SEQ ID NO: 787810 - DNA, 455 bp, Homo sapiens
  misc_feature: NA.5.57.F02.1.454.light.4.nb
ttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtcttcta

SEQ ID NO: 787811 - DNA, 493 bp, Homo sapiens
  misc_feature: NA.52.30.C08.1.454.light.4.nb
aagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattatgtctcctggtaccaacaccacccaggcaaagcccccaaactcattatttatggtgtcggtgaccggccctcaggggtttcgaatcacttctctggctccaagtccggcaacacggcctccctgaccatctctgggctccaggccgaggacgaggctgattattactgcgcctcatatacaaacaacaacaattgggtgttcggcggagggaccaagctgaccgtcctaggtcagcccaaggctgccccctcggtcactctgttcccaccctcctctatacg

SEQ ID NO: 787812 - DNA, 470 bp, Homo sapiens
  misc_feature: NA.10.55.E11.1.454.light.4.nb
ttgggtttgggggagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgccatctga

SEQ ID NO: 787813 - DNA, 501 bp, Homo sapiens
  misc_feature: NA.51.70.G04.1.454.light.4.nb
gctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcgggacagggtatgatgtacactggtaccagcagcttccaggaacagcccccaaactcctcatttattctaacacccatcggccctcaggggtccctgatcgattctctggctccaagtctggcacctcagcctccctggccatcactggactccaggctgaggatgaggctgattattactgccagtcctatgacatcagcctgagtggttcgtgggtattcggcggagggaccagactgaccgtcctaagtcagcccaaggctgccccctcggtcactctgttcccaccctcctctcgtagcact

SEQ ID NO: 787814 - DNA, 448 bp, Homo sapiens
  misc_feature: NA.21.55.E11.1.454.light.4.nb
ttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacacctttttaaattggtatcagcacaaaccagggaaggccccaaagctcctgatcgatgctgcatccaatttagagagtggggtcccatccaggttcagtggcgatggatctgggacaaatttcactctcaccatcagcagtctgcaacctgaagattttgcaacttactattgtcaacagagttacagtattcctttcactttcggccctgggaccgaagtcgatatcaaacgaactgtggctgcaccatctgtt

SEQ ID NO: 787815 - DNA, 452 bp, Homo sapiens
  misc_feature: NA.19.83.H06.1.454.light.4.nb
tcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaaactccctcaacgttcggcggagggaccaaggtggagatcaaacgaactgtggctgcaccatctgtcttcta

SEQ ID NO: 787816 - DNA, 443 bp, Homo sapiens
  misc_feature: NA.40.15.B04.1.454.light.4.nb
tccgcgggaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgttggcaaccaaggagcaacttggctgcagcagcaccagggccaccctcccaaagtcctatccgacaggaataacaaccggccctcagggatctcagagagaatatctgcatccaggtcaggaaacacagcctccctgaccattactggactccagcctgaggacgaggctgactattattgctcagcatgggacaccagcctcaatgccgcggtattcggcgcagggaccaagctgaccgtcctaggtcagccccg

SEQ ID NO: 787817 - DNA, 482 bp, Homo sapiens
  misc_feature: NA.51.46.E02.1.454.light.4.nb
ctgatcaggactcctcagttcaccctctcacaatgaggctccctgctcagctcctggggctgctaatgctctgggtcccaggatgcagtggggctgttgtgatgactcagtctccactctccctgcccgtcacccttggacagccggcctccatctcctgcaggtctagtcaaggcctcgtttatagtgatggagacacctacttgagttggtttcaccagaggccaggccaatctccaaggcgcctaatttataaggtttctaaccgggactctggggtcccagacaaattcagcggcagtgggtcaggcactgatttcacactgaaaatcagcagggtggaggctgaggatgttgggatttactactgtatgcaaggtacacactggcctctcactttcggcggagggaccaaggtggagatgaaacgaactgtggctgcaccatctgtcttcatcttcccgccatctgatcgtagcact

SEQ ID NO: 787818 - DNA, 436 bp, Homo sapiens
  misc_feature: NA.51.47.E03.1.454.light.4.nb
agagagaaggggctgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgtcctgagtcagaccccg

SEQ ID NO: 787819 - DNA, 474 bp, Homo sapiens
  misc_feature: NA.9.14.B03.1.454.light.4.nb
tccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatcaaaaaaatatgtttattggtaccaacagaagtcaggccaggccccccttctagtcatctatgaggacgccaggcgaccctccgggatccctgagagaatctcgggctccagttcagggacagtggccaccttgacgatcggtggggcccaggtggaagatgaagctgactacttctgttactcaacagacgacagtgcggatcatagagggatgttcggcggagggaccaagctgaccgtcctaggtcagcccaaggctgccccctcggtcactctgttcccaccctcct

SEQ ID NO: 787820 - DNA, 441 bp, Homo sapiens
  misc_feature: NA.12.10.A10.1.454.light.4.nb
agggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttaccctcgtattttcggccctgggaccacagtagatatcaaacgaactgtggctgcaccatt

SEQ ID NO: 787821 - DNA, 462 bp, Homo sapiens
  misc_feature: NA.7.59.F04.1.454.light.4.nb
tagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatcaaacgaactagtggctgcaccatctgtcttcatcttccccg

SEQ ID NO: 787822 - DNA, 463 bp, Homo sapiens
  misc_feature: NA.7.1.A01.1.454.light.4.nb
aaggaagggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaagctgaccgtcctaggtcagcccaaggctgccccctc

SEQ ID NO: 787823 - DNA, 470 bp, Homo sapiens
  misc_feature: NA.17.2.A02.1.454.light.4.nb
agggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccactgtcactctgttcccaccct

SEQ ID NO: 787824 - DNA, 455 bp, Homo sapiens
  misc_feature: NA.4.23.C01.1.454.light.4.nb
tagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaagggaccaaggtggaaatcaaacgaactgtggctgcaccatctgtctt

SEQ ID NO: 787825 - DNA, 537 bp, Homo sapiens
  misc_feature: NA.40.33.C11.1.454.light.4.nb
ttgggtttgggcacgaccggtgctcgatttagagtgagctcgttgggtttggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtcctaggtcagcccaaggctgccccctcggtcactctgttcccaccctcctcagtcgctaga

SEQ ID NO: 787826 - DNA, 456 bp, Homo sapiens
  misc_feature: NA.49.63.F08.1.454.light.4.nb
aggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcggctatttaaattggtatctgcacagtccagggaaagcccctaaggtcctgatttatgctgcatccagtttgcaaagtggggtcccatcaaggttcattggcagtggatttgggacagatttcactctcaccatcaccagtctgcgacctgaggattttggaacatactactgtcaacacagttacagtataccgtacagttttggccaggggaccaagctggagatcacacgaactgtggctgcaccatctgtcttcatcttcccgcc

SEQ ID NO: 787827 - DNA, 445 bp, Homo sapiens
  misc_feature: NA.49.7.A07.1.454.light.4.nb
aggggccttcaggccataatgagcgtctctgttttcagggtctctctcccagcctgtggtgactcaatcatcctctgcctctgcttccctgggatcctcggtcaagctcacctgcactctgagcagtgggcacagtacctacatcatcgcatggcataccagcagccagggaaggcccctcggtacttgatgaagcttgaacgtagtggaagcaacaacatggggggcggagttcctgatcgcttctcaggctccagttctgggcctgacttctacctcaccatctccagcctccagtctgaggatgaggctgattattactgtgagacctgggacagtaacactcatactccctcattcggcggagggaccaagctgaccgtcctaggtcagcccaaggctcgccccctcggtcactctgttcccaccctcctctctctcgact

SEQ ID NO: 787828 - DNA, 473 bp, Homo sapiens
  misc_feature: NA.52.61.F06.1.454.light.4.nb
ctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattatgtctcctggtaccaacaccacccaggcaaagcccccaaactcatgatttatggtgtcggtgaccggccctcaggggtttcgaatcgcttctctggctccaagtccggcaacacggcctccctgaccatctctggcctccaggccgaggacgaggctgattattactgcgcctcatatacaaacaacaacaattgggtgttcggcggagggaccaagctgaccgtcctaggtcagcccaaggctgccccctcggtcactctgttcccaccctcct

SEQ ID NO: 787829 - DNA, 468 bp, Homo sapiens
  misc_feature: NA.53.33.C11.1.454.light.4.nb
ttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaaactgaccgtcctaggtcagcccaaggctgccccctcggtcactctcgttcccc

SEQ ID NO: 787830 - DNA, 441 bp, Homo sapiens
  misc_feature: NA.49.70.G04.1.454.light.4.nb
agtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccggggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcatc

SEQ ID NO: 787831 - DNA, 472 bp, Homo sapiens
  misc_feature: NA.9.74.G08.1.454.light.4.nb
aggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccaaggtgaccgtcctacgtcagcccaaggctgccccctcggtcactctgttcccccctcctc

SEQ ID NO: 787832 - DNA, 481 bp, Homo sapiens
  misc_feature: NA.9.71.G05.1.454.light.4.nb
tcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctgttcccaccctcctcagacgtatca

SEQ ID NO: 787833 - DNA, 416 bp, Homo sapiens
  misc_feature: NA.48.82.H05.1.454.light.4.nb
cacgaccggtgctcgatttagcacacgatagttgggtttgggggtgggctcaggaggcagagctctgggaatctcaccatggcctggacccctctcctgctccccctcctcactttctgcacaggctcttgaggcctcctatgactgacacagccaccctcggtgtcagtgtccccaggacagacggccaggatcacctgctctggagatgcattgccaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggt

SEQ ID NO: 787834 - DNA, 449 bp, Homo sapiens
  misc_feature: NA.48.54.E10.1.454.light.4.nb
aacacacaaaggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatttcctgcactgggaccagctccaacatcggcgtaggttatgatgtacactggtaccagcaacttccaggaacagtccccagactcctcatctatgataacaacaatcggccctcaggggtccctgaccggttctctggctccaagtctggcacctcagcctccctggccatcactgggctccagactgaggatgaggctgattattactgccagtcctatgacagcaacctgagcggttgggtgttcggcggagggaccagggtgtacccg

SEQ ID NO: 787835 - DNA, 491 bp, Homo sapiens
  misc_feature: NA.17.28.C06.1.454.light.4.nb
cagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccaccctcctcctagtctacg

SEQ ID NO: 787836 - DNA, 467 bp, Homo sapiens
  misc_feature: NA.49.47.E03.1.454.light.4.nb
agagagaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggcccctgtactggtcatctacgaggacagtaaacgaccctccgggatccctgcgagattctctgcctctagttcagggacaatggccaccttgactatcagtggggcccaggtggaggatgaagctgactactattgttactcaacagacagcagtgccgagggggtgttcggcggagggaccaagctgaccgtcctaggtcagcccaaggctgccccctcggtcactctgttccc

SEQ ID NO: 787837 - DNA, 342 bp, Homo sapiens
  misc_feature: NA.41.86.H09.1.454.light.4.nb
ttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 787838 - DNA, 507 bp, Homo sapiens
  misc_feature: NA.43.67.G01.1.454.light.4.nb
ttgggtttgggcggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaaatcaaacgaactagtggctgcaccatctgtcttcta

SEQ ID NO: 787839 - DNA, 470 bp, Homo sapiens
  misc_feature: NA.5.58.F03.1.454.light.4.nb
aagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactgtcactctcg

SEQ ID NO: 787840 - DNA, 445 bp, Homo sapiens
  misc_feature: NA.51.64.F09.1.454.light.4.nb
agggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttctaacaacctagcctggtatcagcagaagcctggccaggctcccaggctcctcatctatggttcatccaccagggccgctgatatcccagccaggttcagtggcagtgggtctgggacagaattcactctcaccatcagcagcctgcagtctgaagattttgcagtttattactgtcagcagtatgataagtggcctccgtacacttttggccaggggaccaggctggagatcaaacgaactgtggctgcaccatctgt

SEQ ID NO: 787841 - DNA, 470 bp, Homo sapiens
  misc_feature: NA.5.48.E04.1.454.light.4.nb
agacctctggagaagagctgctcagttaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagactttgcgctgtatttctgtcagcagtatgttttcgcacctttcactttcggcggagggaccaaggtggagagcagacgaactgtggctgcaccatctgtcttcatcttcccgccatct

SEQ ID NO: 787842 - DNA, 458 bp, Homo sapiens
  misc_feature: NA.2.34.D01.1.454.light.4.nb
ttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctcggtcactctgttcccaccctcctctgtcgagcgt

SEQ ID NO: 787843 - DNA, 429 bp, Homo sapiens
  misc_feature: NA.49.69.G03.1.454.light.4.nb
tgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaa

SEQ ID NO: 787844 - DNA, 447 bp, Homo sapiens
  misc_feature: NA.43.63.F08.1.454.light.4.nb
agggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcgtacgttcggccaagggaccaaggtggaaatcaaacgaactgtggctgcaccatctgtctt

SEQ ID NO: 787845 - DNA, 489 bp, Homo sapiens
  misc_feature: NA.53.81.H04.1.454.light.4.nb
cacgaccggtgctcgatttagtagtgtagattcgcggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcctgttctggaagcaggtccaacatcggaagtgattttgtattctggtaccagctgctcccaggagcgggccccaaactcctcatttacaggaatgatcagcggccctcaggggtccctgaccgattctctggctccaagtctggcacctcagcctccctggccatcagtggcctccggtccgacgatgaggctgattattattgtgcagcatgggatgacagcctgagtggtgtggtattcggcggagggaccaagctgaccgtcctaggtcagcccaaggctcg

SEQ ID NO: 787846 - DNA, 473 bp, Homo sapiens
  misc_feature: NA.51.6.A06.1.454.light.4.nb
aggggcctggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcactctcg

SEQ ID NO: 787847 - DNA, 456 bp, Homo sapiens
  misc_feature: NA.12.37.D04.1.454.light.4.nb
ttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgaactgtggctgcaccatctgtcttca

SEQ ID NO: 787848 - DNA, 476 bp, Homo sapiens
  misc_feature: NA.5.27.C05.1.454.light.4.nb
ggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtgtctgat

SEQ ID NO: 787849 - DNA, 457 bp, Homo sapiens
  misc_feature: NA.52.60.F05.1.454.light.4.nb
gggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaaccccactgtcactctcg

SEQ ID NO: 787850 - DNA, 473 bp, Homo sapiens
  misc_feature: NA.51.67.G01.1.454.light.4.nb
ttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccgaaggtggagatcaagcgaactgtggctgcaccatctgtcttcatcttcccgccatctgatcgtagcact

SEQ ID NO: 787851 - DNA, 472 bp, Homo sapiens
  misc_feature: NA.16.73.G07.1.454.light.4.nb
agggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttcccgccta

SEQ ID NO: 787852 - DNA, 447 bp, Homo sapiens
  misc_feature: NA.19.75.G09.1.454.light.4.nb
aggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgttggcaaccaaggggcagcttggctgcagcagcaccggggccaccctcccaagctcctgtcctacaggaataccaaccggccctcagggatctcagagagattctctgcatccaggtcaggaaacacagcctccctgaccatttctggactccagcctgacgacgaggctgactattactgttcagcgtgggacagcagcctcgctgcttgggtgttcggcggagggaccaagctcgaccctcctgggtcagcccaaggc

SEQ ID NO: 787853 - DNA, 458 bp, Homo sapiens
  misc_feature: NA.43.42.D09.1.454.light.4.nb
agggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggcggagggaccaaggtggagatacaaacgaactgtggctgcaccatctgtcttcta

SEQ ID NO: 787854 - DNA, 449 bp, Homo sapiens
  misc_feature: NA.52.85.H08.1.454.light.4.nb
tcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattggggggaaaatatgcttgctggtatcaacagcggccaggccagtcccctgtactggtcatctatctgaatagtaggcggccctctgggatccctgaccgattctctggctcccactctgggaacacagccactctgaccatcagcgggacccaggctttggatgaggctgactattactgtcaggcgtgggacaccatcactggagtaatattcggcggagggaccaggctgaccgtcctaggtcagcccaaggctgccccctcggt

SEQ ID NO: 787855 - DNA, 454 bp, Homo sapiens
  misc_feature: NA.43.39.D06.1.454.light.4.nb
cagttctttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 787856 - DNA, 435 bp, Homo sapiens
  misc_feature: NA.26.45.E01.1.454.light.4.nb
tgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaaggtggagatcaaacgaactgt

SEQ ID NO: 787857 - DNA, 448 bp, Homo sapiens
  misc_feature: NA.26.23.C01.1.454.light.4.nb
tagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtggctgcaccatctgtt

SEQ ID NO: 787858 - DNA, 507 bp, Homo sapiens
  misc_feature: NA.41.8.A08.1.454.light.4.nb
agggcacgaccggtgctcgatttagcatactctacaggggggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtggggtcccatcaaggttcagcggcagtggatctgggacagatttcactctcaccatcagcagcctgcagcctgacgattttgcaacttactattgtcaacaggctaacagtttcccgatgaccgtcggccaagggacacgactggacattaaacgaactgtggctgcaccatctgtcttcatcttcccgccatctgaatagtataga

SEQ ID NO: 787859 - DNA, 470 bp, Homo sapiens
  misc_feature: NA.14.85.H08.1.454.light.4.nb
tcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgaggctgattattactgcagctcacatgcagtcagtaacaatttcggggttttcggcggagggaccaagctgaccgtcctaagtcagcccaaggctgccccctcggtcactctcg

SEQ ID NO: 787860 - DNA, 465 bp, Homo sapiens
  misc_feature: NA.14.57.F02.1.454.light.4.nb
ttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaaggtggagttcaaacgaactgtggctgcaccatctgtcttcatcttcccgccta

SEQ ID NO: 787861 - DNA, 451 bp, Homo sapiens
  misc_feature: NA.21.9.A09.1.454.light.4.nb
agggggcaggagtcagacccagtcaggacacagcatggacatgagggtccccgctcagctcctggggctcctgctgctctggctcccaggtgccaaatgtgacatccagatgacccagtctccttccaccctgtctgcatctgtggggggcagagtctccatcacttgccgggccagtcagaatatttatagctggttggcctggtatcagcagaaaccagggaaagcccctaacctcctgatatatcgggcgtctaatttagaaagtggggtcccatcgaggttcagcggcagtggctctgggacagaattcactctcaccatcagcggcctgcagcccgatgattttgcaacttattactgccaacattacaatgattactcgcgtacgttcggccaagggaccagggtggaaatcaaacgaactgtggctgcaccatctgtcttcatt

SEQ ID NO: 787862 - DNA, 463 bp, Homo sapiens
  misc_feature: NA.21.38.D05.1.454.light.4.nb
ttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttccccg

SEQ ID NO: 787863 - DNA, 463 bp, Homo sapiens
  misc_feature: NA.22.38.D05.1.454.light.4.nb
ttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgaagattttgcagtttattactgtcagcagcgtagcatctggcctccgtacacctttggccaggggaccaagctggagatcaaacgaactgtggctgcaccatctgtcttcatcttcc

SEQ ID NO: 787864 - DNA, 455 bp, Homo sapiens
  misc_feature: NA.13.67.G01.1.454.light.4.nb
ttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgt

SEQ ID NO: 787865 - DNA, 478 bp, Homo sapiens
  misc_feature: NA.52.83.H06.1.454.light.4.nb
tcgcgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcggcggagggaccaaggtcgagatcaaacgaactgtggctgcaccatctgtcttcatcttcccgccatctgatatacgatcg

SEQ ID NO: 787866 - DNA, 475 bp, Homo sapiens
  misc_feature: NA.49.11.A11.1.454.light.4.nb
agggggctgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcg

SEQ ID NO: 787867 - DNA, 479 bp, Homo sapiens
  misc_feature: NA.51.39.D06.1.454.light.4.nb
cagttctttggggggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcagggacactggtcacattgaccatcagtggagtccaggcagaagacgaggctgactatttctgtcaatcttcagacgtcagtggtacttatgtcttcggaactgggaccaaggtcaccgtcctaggtcagcccaaggccaacccactgtcactcttccg

SEQ ID NO: 787868 - DNA, 464 bp, Homo sapiens
  misc_feature: NA.10.26.C04.1.454.light.4.nb
ctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgccta

SEQ ID NO: 787869 - DNA, 466 bp, Homo sapiens
  misc_feature: NA.16.66.F11.1.454.light.4.nb
agggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccaccctcctcgac

SEQ ID NO: 787870 - DNA, 456 bp, Homo sapiens
  misc_feature: NA.40.54.E10.1.454.light.4.nb
aacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggcggagggaccaagctgaccgtcctaggtcagcccaaggctgccccctcggt

SEQ ID NO: 787871 - DNA, 446 bp, Homo sapiens
  misc_feature: NA.3.5.A05.1.454.light.4.nb
agggggcaggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaacttactattgtcagagttctaattctttcccgcgcacgtttggccaggggaccaaggtagagatcaaacgaactgtggctgcaccatctgt

SEQ ID NO: 787872 - DNA, 458 bp, Homo sapiens
  misc_feature: NA.9.75.G09.1.454.light.4.nb
agggggcaggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaactcttgatctatgaggcctctggtttacaaagtggggtcccatcaagattcagcggcagtggatctgggacagaattcactctcaccatcagcagtctgcagcctgatgattttgcaacttattactgccaacagtataatagttatccgtggacatttggccaagggaccgaggtggaagtcaaacgaactgtggctgcaccatctgtcttcatcttccccg

SEQ ID NO: 787873 - DNA, 454 bp, Homo sapiens
  misc_feature: NA.49.39.D06.1.454.light.4.nb
cagttctttggggaagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacattgggactaattatgtttcctggtaccagcacctcccaggaacagcccccaaacgcctcatctatgaagataataagcgaccctcagggattcctgaccgattctctggctccaagtctggcacgtcagccaccctggacatcaccggactccagactggggacgaggccgattattactgcggaacatgggatagcagcctgagtgttgtgattttcggcggagggaccaagctgaccgtcctac

SEQ ID NO: 787874 - DNA, 456 bp, Homo sapiens
  misc_feature: NA.11.60.F05.1.454.light.4.nb
gggaaagggggaggaactgctcagttaggacccagacggaaccatggaagccccagcgcagcttctcttcctcctgctactctggctcccagataccactggagaaattgtgatgacgcagtctccagccaccctgtctgtgtctccaggggaaagagccaccctctcctgcagggccagtcagagtattagcagcaacttagcctggtaccaacaaaaacctggccaggctcccaggctcctcttctatggtgcatccaacagggccgctggtatcccagccaggttcagtggcagtgggtctgcgacagagttcactctcaccatcagcagtctgcagtctgaagattttgcagtttattactgtcagcagtataatgactggcctcccacgtggacgttcggccaagggaccaaggtggaaatcaaacgaactgtggctgcaccatctgtctt

SEQ ID NO: 787875 - DNA, 483 bp, Homo sapiens
  misc_feature: NA.48.66.F11.1.454.light.4.nb
agggcttgatgccttggggaagcctgagaacacttagccttcatgagtgtccccaccatggcctggatgatgcttctcctcggactccttgcttatggatcaggcgtgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggttttctggctccatcgttgggggcaaagccgccctcaccatcacgggggcccaggcagaggatgaggcgaattattattgtatgctccacaggggcaggggcacctgggagttcggcggcgggaccaagctgaccgtcctaggtcagcccaaggctgccccctcggtcactctgttccca

SEQ ID NO: 787876 - DNA, 466 bp, Homo sapiens
  misc_feature: NA.12.73.G07.1.454.light.4.nb
aggggctgggcccaaggaagcagcactggtggtgcctcagccatggcctggaccgttctcctcctcggcctcctctctcactgcacagcctctgtgacctcctatgtactgattcagtcgccctcggtgtcagtggccccaggacagacggccacgattacctgtggaggagacaatattgtcaccaaaagtgttcactggtaccagcagaagccaggccaggcccctgtggtggtcgtctatgatgatagcgaccggccctcggggatccctgagcgattctctggctccaactctgggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttcccaccct

SEQ ID NO: 787877 - DNA, 456 bp, Homo sapiens
  misc_feature: NA.26.80.H03.1.454.light.4.nb
aagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaacgaactgtggctgcaccatctgtcttcatcttcccgccat

SEQ ID NO: 787878 - DNA, 468 bp, Homo sapiens
  misc_feature: NA.11.12.B01.1.454.light.4.nb
tccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgccccctcggtcactcc

SEQ ID NO: 787879 - DNA, 473 bp, Homo sapiens
  misc_feature: NA.7.34.D01.1.454.light.4.nb
ttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcacttcg

SEQ ID NO: 787880 - DNA, 510 bp, Homo sapiens
  misc_feature: NA.9.34.D01.1.454.light.4.nb
ttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccaccctcctcagacgtatca

SEQ ID NO: 787881 - DNA, 493 bp, Homo sapiens
  misc_feature: NA.52.1.A01.1.454.light.4.nb
agggcacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcaccatctgtcttcatcttcccgccat

SEQ ID NO: 787882 - DNA, 480 bp, Homo sapiens
  misc_feature: NA.13.77.G11.1.454.light.4.nb
aagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctcgggctccaactctgggaacacggccactctgaccatcagtagggtcgaagccggggatgaggccgactattactgtcaggcgtgggatagtagtcgtgagcatgtggtattcggcggagggaccaaactgaccgtcctaggtcagcccaaggctgccccctcggtcactctgttcccagccctcct

SEQ ID NO: 787883 - DNA, 469 bp, Homo sapiens
  misc_feature: NA.52.17.B06.1.454.light.4.nb
agggcacgaccggtgctcgatttagtcgatagtgaaggggtgatcaggactcctcagttcaccttctcacaatgaggctccctgctcagctcctggggctgctaatgctctgggtctctggatccagtggacaaattgtgctgactcagtctccactctccctgcccgtcacccctggagagccggcctccatctcctgcaggtctagtcagagcctcctgcattataatggataccagtatttggactggtacctacagaaggcagggcagtctccacagctcctgatctatttgggttcttatcgggcctccggggtccctgacaggttcagtggcagcggatcaggcacaaattttacactgagaatcagcagagtggaggcagaggatgttggggtttattattgcatgcaaggtctacaaactcactggacgttcggccaagggaccaaggtggaaatcaaacg

SEQ ID NO: 787884 - DNA, 440 bp, Homo sapiens
  misc_feature: NA.51.77.G11.1.454.light.4.nb
aagggaaagggggagtcagtcccaaccaggacacagcatggacatgagggtccctgctcagctcctggggctcctgctgctctggctctcaggtggcagatgtatcatccagatgacccagtctccatcctccctgtctgcatatataggagacagaatcaccatcacttgccgggcgagtcaggacattagcgtatatttgaattggtatcagcaaaaaccagggaaagcccctgagctcctgatcctcgatgcatccactttggaaacaggggtcccatcaaggttcagtggaagtggctctgggacacattttactttcaccatcagcagactgcagcctgaagatgttgcaacatattactgtcaacagtatcataatctcccgctcactttcggcggagggaccaaggtggagatcaaacgaactgtggctgcac

SEQ ID NO: 787885 - DNA, 457 bp, Homo sapiens
  misc_feature: NA.47.64.F09.1.454.light.4.nb
agggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgtcttcattccccg

SEQ ID NO: 787886 - DNA, 407 bp, Homo sapiens
  misc_feature: NA.19.86.H09.1.454.light.4.nb
ttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacc

SEQ ID NO: 787887 - DNA, 514 bp, Homo sapiens
  misc_feature: NA.49.20.B09.1.454.light.4.nb
agggcttgatgccttggggtgggaggagagacccctcccctgggatcctgcagctctagtctcccgtgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctcggtcactc

SEQ ID NO: 787888 - DNA, 457 bp, Homo sapiens
  misc_feature: NA.51.62.F07.1.454.light.4.nb
aagggaaagggggagtcagtcccaaccaggacacagcatggacatgagggtccctactcagctcctggggctcctgctgctctggctctcaggtgccagatgtgacatccagatgacccagtctccgtcctccctgtctgcgtctgtaggagacagagtcaccatcacttgccaggcgagtcaggacattagcaacaatttgatctggtatcagcagaaacctggcagagcccctagtctcatgatctatgatgcatctattttggaagacggggtcccatcccggttcagtgggagtggatctgggactaaatttttctttcaccatcaccaacctgcaacctgaggattttgcaacatatttctgtcaacaatatgataatgtccccaccgtcactttcggcggagggaccaaggtggacctcaaacgaactgtggctgcaccatctgtcttcta

SEQ ID NO: 787889 - DNA, 439 bp, Homo sapiens
  misc_feature: NA.13.4.A04.1.454.light.4.nb
agggggcagggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaagggacacgactggagattaaacgaactgtggctgcacc

SEQ ID NO: 787890 - DNA, 512 bp, Homo sapiens
  misc_feature: NA.8.53.E09.1.454.light.4.nb
ttggggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgacacgcgag

SEQ ID NO: 787891 - DNA, 491 bp, Homo sapiens
  misc_feature: NA.40.36.D03.1.454.light.4.nb
atctctcttgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggaccaagtggaaatcaaacgaactgtggctgcaccatctgtcttcatcttcccgccatctgaagtcgctaga

SEQ ID NO: 787892 - DNA, 465 bp, Homo sapiens
  misc_feature: NA.51.71.G05.1.454.light.4.nb
tggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcacttcc

SEQ ID NO: 787893 - DNA, 467 bp, Homo sapiens
  misc_feature: NA.53.5.A05.1.454.light.4.nb
agcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggcccctctattggtaatgtataaagacaatgagaggccctcagggatccctgagcgattctctggctccaactcagggacaacagtcacgttgaccatcggtggagtccaggcagaagacgaggctgactattactgtcaatcagcaggcagcagtggaactgtgcttttcggcggagggaccaagctgaccgtcctacgtcagcccaaggctgccccctcggtcactctgttccccg

SEQ ID NO: 787894 - DNA, 454 bp, Homo sapiens
  misc_feature: NA.49.31.C09.1.454.light.4.nb
ctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcactcaccatctcctgcactggtggttataactctgtctcctggtaccaacagcacccaggcaaagcccccaaactcatgatttatgaggtcaataggcggccctcaggggtccctgatcgcttctctggctccaagtctggcaccacggcctccctgaccgtctctgggctccaggcagaggatgaggctgattattactgcagctcatctgcaggcattaacaattttaatgtggtattcggcggagggaccaagctgaccgtcctaggtcagcccaaggctgccccctcggtcactctgttcccg

SEQ ID NO: 787895 - DNA, 454 bp, Homo sapiens
  misc_feature: NA.10.25.C03.1.454.light.4.nb
agagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaaacctggccagcctcccaggctcctcgtctatggtgcatccacaagggccactggtatcccagccaggttcagtggcagtgggtctgggacagagttcgctctcaccatcagcagtctgcagtctgaagattttgcagtttattactgtcaggaatatgatggctggcctccgtacacttttggccaagggaccaagttggacatcaaacgaactgtggctgcaccatctgtctt

SEQ ID NO: 787896 - DNA, 488 bp, Homo sapiens
  misc_feature: NA.17.21.B10.1.454.light.4.nb
aggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtggctgcaccatctgtcttcatcttcccgccatctgactagtctacg

SEQ ID NO: 787897 - DNA, 488 bp, Homo sapiens
  misc_feature: NA.8.39.D06.1.454.light.4.nb
cagttctttggggggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgccatctgagacacgcgacg

SEQ ID NO: 787898 - DNA, 522 bp, Homo sapiens
  misc_feature: NA.52.57.F02.1.454.light.4.nb
ttgggtttgggcacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaagtttgggggttttcggcggagggaccaaggtgaccgtcctacgtcagcccaaggctgccccctggtcactctgttccccg

SEQ ID NO: 787899 - DNA, 479 bp, Homo sapiens
  misc_feature: NA.16.46.E02.1.454.light.4.nb
atctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccaccctcctcgagtagtaca

SEQ ID NO: 787900 - DNA, 438 bp, Homo sapiens
  misc_feature: NA.40.62.F07.1.454.light.4.nb
aagggaaagggcacgaccggtgctcgatttagtagtcgcataaagggaaagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggacctt

SEQ ID NO: 787901 - DNA, 467 bp, Homo sapiens
  misc_feature: NA.48.72.G06.1.454.light.4.nb
aggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttccc

SEQ ID NO: 787902 - DNA, 463 bp, Homo sapiens
  misc_feature: NA.10.21.B10.1.454.light.4.nb
agagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcta

SEQ ID NO: 787903 - DNA, 454 bp, Homo sapiens
  misc_feature: NA.16.10.A10.1.454.light.4.nb
agggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctcggtcactctgttccca

SEQ ID NO: 787904 - DNA, 449 bp, Homo sapiens
  misc_feature: NA.17.49.E05.1.454.light.4.nb
aacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttatggtgcatccaccagggccactggtatcccagccaggttcagtggcagtgggtctgggacagagttcactctcaccatcagcagcctgcagtctgaagattttgcagtttattactgtcagcaatataatgactggcctccgctcactttcggcggagggaccaaggtggagatcaaacgaactgtggctgcacca

SEQ ID NO: 787905 - DNA, 453 bp, Homo sapiens
  misc_feature: NA.4.38.D05.1.454.light.4.nb
ttgggtttgggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaacctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtgtggtagctcaccgacgttcggccaagggaccgaaggtaggaaatcaaacgaaactgtggctgcaccatctgtt

SEQ ID NO: 787906 - DNA, 454 bp, Homo sapiens
  misc_feature: NA.17.43.D10.1.454.light.4.nb
agggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtgcttccaccagggccgctggtgtcccagccagattcaggggcagtgggtctgggacagagttcactctcaccatcagcagcctgcagtctgaagattttgcagtttattactgtcagcactataataactggcccccggggggacgttcggccaagggaccaaggtggagatcaaacgaactgtggctgcaccatctgtcttcatt

SEQ ID NO: 787907 - DNA, 484 bp, Homo sapiens
  misc_feature: NA.43.60.F05.1.454.light.4.nb
gggaaagggcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggccgacgggaccgacggtggagtgtcaagcgaactgtggctgcaccat

SEQ ID NO: 787908 - DNA, 477 bp, Homo sapiens
  misc_feature: NA.12.1.A01.1.454.light.4.nb
agggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaactgtggctgcaccatctgtgtcttcatcttcccgccatctgatacgtcgtat

SEQ ID NO: 787909 - DNA, 452 bp, Homo sapiens
  misc_feature: NA.10.20.B09.1.454.light.4.nb
agggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgctagtttattactgtcagcagtataatgactgggttttattcactttcggccctgggaccaaagtggatttcagacgaactgtggctgcaccatctgtcttcta

SEQ ID NO: 787910 - DNA, 483 bp, Homo sapiens
  misc_feature: NA.27.23.C01.1.454.light.4.nb
tagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccctcct

SEQ ID NO: 787911 - DNA, 485 bp, Homo sapiens
  misc_feature: NA.53.77.G11.1.454.light.4.nb
aagggaaaggggctgggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaaagtgtgcactggtaccagcagatgccaggccaggcccctgtgttggtcgtctatgatgatagcgaccggccctcaggggtccctgagcgattctctggctccaactctgggaacacggccaccctgaccataagcagggtcgaagccggggatgaggccgactattactgtcaggtgtgggatactagtagtgatcatccttgggtgttcggcggtgggaccaggctgaccgtcctaggtcagcccaaggctgccccctcggtcactctgttcccaccctcctctcgta

SEQ ID NO: 787912 - DNA, 454 bp, Homo sapiens
  misc_feature: NA.21.12.B01.1.454.light.4.nb
tcggcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaaccc

SEQ ID NO: 787913 - DNA, 490 bp, Homo sapiens
  misc_feature: NA.11.59.F04.1.454.light.4.nb
taggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccactgtcactctgttcccaccctcctcgtatctctcg

SEQ ID NO: 787914 - DNA, 470 bp, Homo sapiens
  misc_feature: NA.49.14.B03.1.454.light.4.nb
tccgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacagtattttactttcaccatcatcagcctgcagcctgagatattgcaacatattactgtcaacagtatgataatctaccactcactttcggcggagggaccaaggtggagatcaaacgaactgtggctgcaccatctgtcttcatcttcccgccatctgatctctcgact

SEQ ID NO: 787915 - DNA, 475 bp, Homo sapiens
  misc_feature: NA.43.9.A09.1.454.light.4.nb
aggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgctcgggttttcggcggagggaccaagttgaccgtcctaggtcagcccaaggctgccccctcggtcactctgttcccaccctcctcactact

SEQ ID NO: 787916 - DNA, 473 bp, Homo sapiens
  misc_feature: NA.13.53.E09.1.454.light.4.nb
ttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccaacggaccgaacggtaggaaagtacaagacgaactagtggcgtgcgaccactctgtcttctactcttcccgt

SEQ ID NO: 787917 - DNA, 476 bp, Homo sapiens
  misc_feature: NA.9.2.A02.1.454.light.4.nb
aggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaaacttcccctcgttgggtgttcggcggagggaccatgctgaccgtcctgagtcagcccaaggctgccccctcggtcactctgttcccaccct

SEQ ID NO: 787918 - DNA, 464 bp, Homo sapiens
  misc_feature: NA.14.86.H09.1.454.light.4.nb
ttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagctccctagagcctggagtattttgtagtttattactgtcagcagtatagcagctggcctcccactttcggcggagggaccaaggtggagatccaacgaactgtggctgcaccatctgtcttcatcttccccg

SEQ ID NO: 787919 - DNA, 471 bp, Homo sapiens
  misc_feature: NA.52.76.G10.1.454.light.4.nb
agggggctgggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatacacaaacagaaacacttgggtgttcggcggcgggaccaaactgaccgtcctacgtcagcccaaggctgccccctcggtcactctgttccca

SEQ ID NO: 787920 - DNA, 496 bp, Homo sapiens
  misc_feature: NA.15.59.F04.1.454.light.4.nb
tagggattagggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcactctgttcccaccctcctcgctacgtaga

SEQ ID NO: 787921 - DNA, 510 bp, Homo sapiens
  misc_feature: NA.43.81.H04.1.454.light.4.nb
cacgaccggtgctcgatttagtagtgtagattcgcgggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctgttcccaccctcctcactactca

SEQ ID NO: 787922 - DNA, 493 bp, Homo sapiens
  misc_feature: NA.43.29.C07.1.454.light.4.nb
agggaaaggggaggctggtcacacttcttgcaggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccagggtggagatcaaacgaactgtggctgcaccatctgtcttcatcttcccgccatctgaacta

SEQ ID NO: 787923 - DNA, 448 bp, Homo sapiens
  misc_feature: NA.40.41.D08.1.454.light.4.nb
agagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcggggtgttcggcggagggaccaagctgaccgtcctaggtcagcccg

SEQ ID NO: 787924 - DNA, 504 bp, Homo sapiens
  misc_feature: NA.43.15.B04.1.454.light.4.nb
tccgcgggcacgaccggtgctcgatttagacagtatatatccgcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggactttcggccaagggaccaaggtggaattcaaccgaactgtggctgcaccatctgtcttcatcttcccg

SEQ ID NO: 787925 - DNA, 472 bp, Homo sapiens
  misc_feature: NA.43.3.A03.1.454.light.4.nb
aggggctgggggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtccccccaccactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtgttcggcggagggaccaggttgaccgtccttggtcagcccaaggctgccccctcggtcactctgttcccg

SEQ ID NO: 787926 - DNA, 461 bp, Homo sapiens
  misc_feature: NA.53.22.B11.1.454.light.4.nb
agcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 787927 - DNA, 438 bp, Homo sapiens
  misc_feature: NA.4.14.B03.1.454.light.4.nb
tccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtgggagacagagtcactatcacttgccgggccagtcagagcattagtggctggctggcctggtatcagcagaaaccagggagagcccctaagctcttgatctttgatgccaccaatttggaaagtggggtcccatcaagattcagcggcagtggatttgggacagaattcactctcaccatcagcagcctgcagcctggtgattttgcaacttattactgccaacagtataatagttattctctcactttcggcggagggaccaaggtggagatcaaacgaactagtggtc

SEQ ID NO: 787928 - DNA, 480 bp, Homo sapiens
  misc_feature: NA.53.20.B09.1.454.light.4.nb
aggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggaaggacggccacgattacctgtgggggaaacaacattggaagtaaaagtgtgcactggtaccagcacaagccaggccaggcccctgcgctggtcgtctatgatgatagcgaccggccctcagggatccctgagcgattctctggctccaactctggggacacggccaccctgaccatcagcagggtcgaagccggggacgaggccgactattactgtcaggtgtgggattttaatagtgatcattgggtgttcggcggagggaccaagctgaccgtcctaggtcagcccaaggctgccccctcggtcactctgttcccaccctcctctcgtactgcg

SEQ ID NO: 787929 - DNA, 460 bp, Homo sapiens
  misc_feature: NA.9.27.C05.1.454.light.4.nb
agggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttagcctggtaccaacagagacctggccagcctcccaggctcctcatctttgatgcatccactagggccagtggaatcccagacaggttcagtggcagtgggtctgggacagagttcactctcagcatcaacagcgtgcgggctgaagtattttgtttttattattgtcagcagtatgataactggcctctgtggacgttcggccaagggaccaaggtggatgtcaaacgaactgtggctgcaccatctgtcttcattcc

SEQ ID NO: 787930 - DNA, 500 bp, Homo sapiens
  misc_feature: NA.53.49.E05.1.454.light.4.nb
aacacacaaagggcggtgctcgatttagagcgactagcaacacacaaaggggctgggcctaaggaagcagcactggtggtgcctcagccatggcctggaccgttctcctcctcggcctcctctctcactgcacagactctgtgacctcctatgtgctgactcaggcaccctcgctgtctgtggccccaggacagacggccaggattgcttgtgggggaaacaacgttggaagtaacagtgtgcattggtaccagcagaagccacgccaggcccctgtcctggtcttctttgatcatggagaccggccctcagggatccctgagcgattctctggctccaagtctgggaacacggccactttgaccatcatcagggtcgaagccggggatgaggccgactactactgtcagctgtgggacagtagtattcatcagggggcattcggcggagggaccaagctgaccgtcctgggtcagcccaaggctgccccctcggtcact

SEQ ID NO: 787931 - DNA, 455 bp, Homo sapiens
  misc_feature: NA.8.21.B10.1.454.light.4.nb
gagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatctt

SEQ ID NO: 787932 - DNA, 459 bp, Homo sapiens
  misc_feature: NA.14.23.C01.1.454.light.4.nb
tagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgttcggccaagggaccaaggtggaaatcaaacgaactagtggctgcaccatctgtcttcta

SEQ ID NO: 787933 - DNA, 439 bp, Homo sapiens
  misc_feature: NA.48.2.A02.1.454.light.4.nb
agggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccaggggaccaaagtggatgtcaaccgaactgtggctgcacca

SEQ ID NO: 787934 - DNA, 462 bp, Homo sapiens
  misc_feature: NA.10.65.F10.1.454.light.4.nb
agggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggcggagggaccaaggtggagatcaaacgaactgtggctgcaccatctgtcttcatcttccccgccta

SEQ ID NO: 787935 - DNA, 456 bp, Homo sapiens
  misc_feature: NA.7.71.G05.1.454.light.4.nb
agaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtcttcta

SEQ ID NO: 787936 - DNA, 468 bp, Homo sapiens
  misc_feature: NA.13.33.C11.1.454.light.4.nb
ttgggtttggggggggtctcaggaggcagcgctctcggggcgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccagtgacattggtgattataattatgtctcctggtaccaacagtgcccaggcaaagcccccaaactcataatttttactgtcagtcatcggccctcaggggtttctaatcgtttctctggctccaagtctggcaacacggcctccctgaccatctctgggctccaggctgaagacgaggctgattattactgcagctcatatacaagcggcagctctctttatctcttcggaggtgggaccaaggtcaccgtcctaagtcagcccaaggccaacccatgtcact

SEQ ID NO: 787937 - DNA, 445 bp, Homo sapiens
  misc_feature: NA.17.55.E11.1.454.light.4.nb
ttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacagtaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcggagggaccaaggtggagatcaaacgaa

SEQ ID NO: 787938 - DNA, 451 bp, Homo sapiens
  misc_feature: NA.51.11.A11.1.454.light.4.nb
agggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccatctgtcttcatt

SEQ ID NO: 787939 - DNA, 516 bp, Homo sapiens
  misc_feature: NA.9.15.B04.1.454.light.4.nb
tccgcgggggggattagaaagctgggggtctgatttgcatggatggaccctcccactctcagagtatgaagaggggcagggagagatttgggggggctctgcttcagctgtgggcacaagcggcagcactcaggacaatctccagcatggcctggtctcctctcctcctcactctcctcgctcactgcacagagtcctgggcccagtctgtgctgacgcagccgccctcagtgtctggggccccagggcagagggtcaccatctcctgttctgggagcagctccaacatcgggggagactctgatgcacattggtatcagcagcttccagaagcagcccccaaactcctcatctatgctaacaccaatcggccctcaggggtccctgaccgattctctggctccaagtctggcacctcagcctccctgaccatcagtgaattgcagactgaggatgaggctaactactactgccagtcctccgacagcagcctgggtgtttgggtgttcggcggac

SEQ ID NO: 787940 - DNA, 434 bp, Homo sapiens
  misc_feature: NA.47.48.E04.1.454.light.4.nb
aatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggaccgaaggtggaaagtacaaacgaactagtggctgcaccta

SEQ ID NO: 787941 - DNA, 468 bp, Homo sapiens; identical to SEQ ID NO: 787644
  misc_feature: NA.9.33.C11.1.454.light.4.nb

SEQ ID NO: 787942 - DNA, 501 bp, Homo sapiens
  misc_feature: NA.53.71.G05.1.454.light.4.nb
cacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcggcggagggaccaagctgaccgtcctaggtcagcccaaggctgccccctcggtcactctgttccccg

SEQ ID NO: 787943 - DNA, 460 bp, Homo sapiens
  misc_feature: NA.9.19.B08.1.454.light.4.nb
agggggaggctctgcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccagggtcctcatctttggttacagtaatcggccctcaggggtccctgaccgattctctggctccaagtctgacacctcagcctccctggccatcactgggctccagactgaggatgaggctcattattactgccagtcttatgacaaacgtcagaacatttgggtgttcggcggagggaccaagctgaccgtcctcagtcagacccg

SEQ ID NO: 787944 - DNA, 469 bp, Homo sapiens
  misc_feature: NA.17.23.C01.1.454.light.4.nb
tagggattggggctgggcctaaggaagcagctctggtggtgcctcagccatggcctggaccgttctcctcctcggcctcctctctcactgcacaggctctgtggcctcctatgtgctgactcagccaccctcggtgtcagtggccccaggacagacggccacaattacctgcgggggaaggaacattggaagtaaaagtgtgcagtggtaccagcagaagccaggccaggcccctattctggtcgtctatgatgatagcgaccggccctcagggatccctgagcgattctctggctccaactctgacaacacggccaccctgaccatcagtagggtcggagccggggatgagggcgactattactgtcaggtgtgggatcacactagtgatcattatgtcttcggatcggggaccgaggtcaccgtcctaggtcagcccaaggccaaccccactgtcactctgttcccg

SEQ ID NO: 787945 - DNA, 454 bp, Homo sapiens
  misc_feature: NA.12.38.D05.1.454.light.4.nb
ttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggagatcaaacgaactgtggctgcaccatctgtcttcatt

SEQ ID NO: 787946 - DNA, 481 bp, Homo sapiens
  misc_feature: NA.40.4.A04.1.454.light.4.nb
agggggggccgtttgcattgtgaactgagctacaacaggcaggcaggggcagcaagatggtgttgcagacccaggtcttcatttctctgttcctctggatctctggtgccttcggggacatcgtgatgacccagtctccagactccctggctctgtctctgggcgagagggccaccatcaactgcaagtccagccagagcgttttatccacttcctacaatcagaattacttagcttggtatcagcataaaccagggcagcctccgaggctgctcatttactggacatctatccgggaatccggggtccctgaccgattccgtggcagtgggtctgggacagattttactctcaccatcaccagccttcaggctgaagatgtggcagtttattactgtcaccaatatttagacattcctccgacgttcggccaagggaccaaggtggagatcaaacgaactgtggctgcaccatctgtctt

SEQ ID NO: 787947 - DNA, 451 bp, Homo sapiens
  misc_feature: NA.16.67.G01.1.454.light.4.nb
ttgggtttggggggtagctcaggaagcagagcctggagcatctccactatggcctgggctccactacttctcaccctcctcgctcactgcacaggttcttgggccaattttacgctgactcagccccactctgtgtcggagtctccggggaagacggtgaccatctcctgcacccgcagcagtggcagcattgccaggaactttgtgcagtggttccagcagcgcccgggcagtgcccccaccagtgtgatctatgaagataatcaaaggccctctggggtccctgatcgcttctctggctccatcgacacctcctccaactcagcctccctcaccatctctggagtgaagcctgaggacgaggctgactactactgtcagtcttttaatgacaccgttgtgatattcggcggagggaccaagctgaccgtcctaggtcagcccaaggctg

SEQ ID NO: 787948 - DNA, 431 bp, Homo sapiens
  misc_feature: NA.18.76.G10.1.454.light.4.nb
agggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccaaggtggacatcaaacgaa

SEQ ID NO: 787949 - DNA, 455 bp, Homo sapiens
  misc_feature: NA.43.16.B05.1.454.light.4.nb
aggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaacatcacttgccgggcaagtcagactatcaacacccatttaaattggtatcagcagaaacgagggaaagcccctaaactcctgatttatgttgcatccactttacaaactggggtcccatcaaggttcagtggcagtggatctggggcagatttcactctcaacatcggcagtgttcaacctgaagattttgcgacttattattgtcaacagagtcacagtttcccgtacacttttggccaggggaccaggctggagagcaaacgaactgtggctgcaccatctgtcttcatcttccccg

SEQ ID NO: 787950 - DNA, 431 bp, Homo sapiens
  misc_feature: NA.10.87.H10.1.454.light.4.nb
ttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgtcgggcgagtcagcctattagcagctggttagcctggtatcagcagaagccagggggagcccctaagctcctgatctatgctgcatccagtttgcagagtggggtcccgtcaaggttcagcggcagtggatctgggacagatttcgctctcaccatcaacaacctgcagcctgaggattttgcaacttactactgtcaacaggctagcagtttcccactcactttcggccccggaccaaagtggaggtcaaacgaa

SEQ ID NO: 787951 - DNA, 443 bp, Homo sapiens
  misc_feature: NA.4.1.A01.1.454.light.4.nb
agggggaggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtggaaatcaaacgaactgtggctgcaccatctgtcttc

SEQ ID NO: 787952 - DNA, 474 bp, Homo sapiens
  misc_feature: NA.49.16.B05.1.454.light.4.nb
agggggctgtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcagggatccctgagcgattctctggctccagctcagggacaacagtcacgttgaccatcagtggagtccaggcagaagacgaggctgactattattgtcaatcagcagacaccggtggtacttatcgggtgttcggcggagggaccaagctgaccgtcctaggtcagcccaaggctgccccctcggtcactctgttcccaccctcctctct

SEQ ID NO: 787953 - DNA, 465 bp, Homo sapiens
  misc_feature: NA.43.86.H09.1.454.light.4.nb
ttgggtttgggggatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattactgcatgcaaacttcacactggcctccgttcacttttggccaggggaccaaggtggagatcaaacgaactgtggctgcaccatctgtt

SEQ ID NO: 787954 - DNA, 449 bp, Homo sapiens
  misc_feature: NA.22.73.G07.1.454.light.4.nb
agggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaaacgaactgtggctgcaccatctgttctt

SEQ ID NO: 787955 - DNA, 477 bp, Homo sapiens
  misc_feature: NA.19.80.H03.1.454.light.4.nb
aagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctgttcccaccctcctccacg

SEQ ID NO: 787956 - DNA, 390 bp, Homo sapiens
  misc_feature: NA.48.69.G03.1.454.light.4.nb
gatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 787957 - DNA, 442 bp, Homo sapiens
  misc_feature: NA.10.38.D05.1.454.light.4.nb
ttgggtttgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccaccctcctccactactatg

SEQ ID NO: 787958 - DNA, 434 bp, Homo sapiens
  misc_feature: NA.51.16.B05.1.454.light.4.nb
aggggaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatctcttgccaggcgagtcaggacattataagatatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaggatcttgcaacatattactgtcaacagtatgataatgtcccgtacacttttggccaggggaccaagctggagatcagacgaactgtggctgca

SEQ ID NO: 787959 - DNA, 464 bp, Homo sapiens
  misc_feature: NA.9.67.G01.1.454.light.4.nb
ttgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtgggtctgggacagagttcgttctcaccatcagcagcctgcagtctgaagattttgctagtttattactgtcagcactataatagttggccgctcactttcggcggagggaccaaggtggagctcaaacgaactgtggctgcaccatctgtcttcatcttccccg

SEQ ID NO: 787960 - DNA, 452 bp, Homo sapiens
  misc_feature: NA.13.87.H10.1.454.light.4.nb
ttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgtcttcta

SEQ ID NO: 787961 - DNA, 452 bp, Homo sapiens
  misc_feature: NA.15.49.E05.1.454.light.4.nb
aacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaaatcaaacgaactgtggctgcaccatctgtt

SEQ ID NO: 787962 - DNA, 403 bp, Homo sapiens
  misc_feature: NA.9.9.A09.1.454.light.4.nb
agggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccaccctcctcagacgtatca

SEQ ID NO: 787963 - DNA, 495 bp, Homo sapiens
  misc_feature: NA.43.36.D03.1.454.light.4.nb
atctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccaccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaactgtggctgcaccatctgtcttcatcttcccgccatctgaactactcaca

SEQ ID NO: 787964 - DNA, 444 bp, Homo sapiens
  misc_feature: NA.3.88.H11.1.454.light.4.nb
aacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttccctttaatcttcggccaagggacacgactggagattaaacgaactgtggctgcacca

SEQ ID NO: 787965 - DNA, 451 bp, Homo sapiens
  misc_feature: NA.4.9.A09.1.454.light.4.nb
agggggaggaactgctcagttaggacccagacggaaccatggaagccccagcgcagcttcttttcctcctgctactctggctcccagataccactggagaaatagtgatgacgcagtctccagccaccctgtctgtgtctccaggggcaagggccaccctctcctgcagggccagtcagagtgtcagcaacaacttagcctggtaccagcagaaacctggccagcctcccaggctcctcatctatggtacatccaccagggccactggtattccagtcaggtttagtggcagcgggtctgggacagaattcactctcaccatcagcagcctgcagtctgaagattttgcagtttattactgtcagcagtataataattggcctcccttcactttcggccctgggaccaaagtggatatcaaacgaactgtggctgcaccatctgtcttcta

SEQ ID NO: 787966 - DNA, 457 bp, Homo sapiens
  misc_feature: NA.10.79.H02.1.454.light.4.nb
agggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtcttcta

SEQ ID NO: 787967 - DNA, 688 bp, Homo sapiens
  misc_feature: NA.21.25.C03.1.454.light.4.nb
cggtcccgccgccgaacagccaaaaccacgcagggtgttgtcataggactggcaataataatcagcctcatcgtcagcctggagcccagcgatgaccagggaggctgaggtgccagacttggagccagagaatcggtcagggacccctgagggccgattgctgttaccatagatgaggagtttggaggctctgcttcagctgtgggcacaagaggcagcactcaggacaatctccagcatggcctggtctcctctcctcctcactctcctcgctcactgcacagggtcctgggcccagtctgtgctgacgcagccgccctcggtgtctggggccccagggcagacggtcaccatctcctgcgctgggagcagctccaacatcgggtcaccttttgatgtgcactggtatcagcaacttccaggaacagcccccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggtttttggctgttcggcggcgggaccaagctgaccgtcctaggtcagcccaaggctgccccctcggtcactctgttcccgccctcctccgagcgacga

SEQ ID NO: 787968 - DNA, 444 bp, Homo sapiens
  misc_feature: NA.40.77.G11.1.454.light.4.nb
aagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaagcccctaagctcctgatctataaggcatctagtttagaaagtggggtcccatccaggttcagcggcagtggatctgggacagaattcgctctcaccatcagcagcctgcagcctgatgattttgcaacttattactgccaacactatgatagttattctccgtacacctttggccaggggaccaaggtggagatcaagcgaactgtggctgcacc

SEQ ID NO: 787969 - DNA, 398 bp, Homo sapiens
  misc_feature: NA.8.73.G07.1.454.light.4.nb
agggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgacac

SEQ ID NO: 787970 - DNA, 490 bp, Homo sapiens
  misc_feature: NA.40.74.G08.1.454.light.4.nb
gggggggaagctcagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccgccct

SEQ ID NO: 787971 - DNA, 457 bp, Homo sapiens
  misc_feature: NA.13.30.C08.1.454.light.4.nb
aagggaaaggggcctcggggacccttgggctgatccttggtctcctgctcctcaggctcacctgggcccagtagtgactcactagagtgtgtttctccctctttccaggctcttgggcccagtctgccctgattcagcctcctcccgcgtccgagtctcttggtcagtcagtcaccatctcctaagctggagccagcagtgattttgggagttttgactctgtctcttgggtccagcaacacccagtcacaggccccaaagtcatgctgtgcaatgtcactcttcagtcctcaagagtccctgatttttctctgcctcgaggtcttgcagtccggcctccgaggccatcactggactccaggctgcgggcgaggctgcctctttgtgcttggcaaggcggcctctatgaccatctctggactccaggctgcggacgaggctgattgttggtgctggt

SEQ ID NO: 787972 - DNA, 454 bp, Homo sapiens
  misc_feature: NA.2.71.G05.1.454.light.4.nb
ctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcacttcc

SEQ ID NO: 787973 - DNA, 433 bp, Homo sapiens
  misc_feature: NA.11.73.G07.1.454.light.4.nb
agggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccagagtggacatgaaacgaactgtggctgca

SEQ ID NO: 787974 - DNA, 446 bp, Homo sapiens
  misc_feature: NA.43.76.G10.1.454.light.4.nb
aggggactgcgggggtaagaggttgtgtccaccatggcctggactcctctcctcctcctgttcctctctcactgcacaggttccctctcgcaggctgtgctgactcagccgtcttccctctctgcatctcctggagcatcagccagtctcacctgcaccttgcgcagtggcatcaatgttgctacccacacaatatactggtaccagcagaagtcagggagtcctccccagtttctcctgaggtacaaatcagactcagataagcagcagggctctggaatccccagccgcttctctggatccaaggatgcttcggccaatgcaggaattttgctcatctctgggctccagtctgaggatgaggctgactattactgtacgatttggcacaacgacgctgtggttttcggcggagggaccaagctgaccgtcctaagtcagacccg

SEQ ID NO: 787975 - DNA, 460 bp, Homo sapiens
  misc_feature: NA.4.52.E08.1.454.light.4.nb
agagagaaaggggcagagccctggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccgacagggccactggcatcccagccaggttcagtggcagtgggtctgggacagacttcactctcaccatcaccagcctagagcctgaggattttgcagtttattactgtcagcagcgtagcaactggcctctgctcactttcggcggagggaccaaggtggagatcaaacgaactgtggctgcacca

SEQ ID NO: 787976 - DNA, 485 bp, Homo sapiens
  misc_feature: NA.53.38.D05.1.454.light.4.nb
ttgggtttgggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactctgttcccgccctcctctcgtactgcg

SEQ ID NO: 787977 - DNA, 464 bp, Homo sapiens
  misc_feature: NA.14.3.A03.1.454.light.4.nb
aggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccgtcctaggtcagcccaaggctgccccctcggtcactctcg

SEQ ID NO: 787978 - DNA, 454 bp, Homo sapiens
  misc_feature: NA.5.55.E11.1.454.light.4.nb
ttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacaatttcaacagtaagaactacttagcttggtaccagcagaaaccaggacagcctcctaggctgctcatttactgggcatctacccgggaatccggggtccctgaccgattcagtggcagcggctctgggacagatttcactctcaccatcagcagcctgcaggctgaagatgtggcagtttattactgtcagcaatattttattactcctctgacgttcggccaagggaccaaggtggaaatcaaacgaactgtggctgca

SEQ ID NO: 787979 - DNA, 492 bp, Homo sapiens
  misc_feature: NA.5.39.D06.1.454.light.4.nb
cagttctttgggcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaactgtggctgcaccatctgtctt

SEQ ID NO: 787980 - DNA, 487 bp, Homo sapiens
  misc_feature: NA.15.1.A01.1.454.light.4.nb
aggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctcgctacgtaga

SEQ ID NO: 787981 - DNA, 475 bp, Homo sapiens
  misc_feature: NA.49.71.G05.1.454.light.4.nb
agtctgggcctaaggaagcagcactggtggtgcctcagccatggcctggaccgttctcctcctcggcctcctctctcactgcacaggctctgtgacctcctatgtgctgactcagacaccctcggtgtcggtggccccaggacagacggccttgattccctgtatgggagacgacattggaagtaagagtgtccactggtaccagcagaagccaggccaggcccctcttttggtcgtctatgatgatcgcgaccggcccgcaggggtccctgaacgattctctggcgccagctctcagaacacggccaccctgatcatcaacagggtcgaagtcggggatgaggccgactattactgtcaggtctgggatactgaaattgaatatgtcttcggaactgggaccaaagtcaccgtcctaggtcagcccaaggccaaccccactgtcactctgttcccaccctcctctctctcgact

SEQ ID NO: 787982 - DNA, 447 bp, Homo sapiens
  misc_feature: NA.9.31.C09.1.454.light.4.nb
tcgtcaggaggcagcgctctcgggacgtctccaccatggcctgggctctgctattcctcaccctcctcactcagggcacagggtcttgggcccagtctgccctgactcagcctgcctccgtgtctgggtctcctggacagtcgatagccatctcctgcactggaactaacagtgacgttggtgcttataattatgtctcctggtatcaacaacacccaggcaaagccccccaactcattatttctgatgtcaacaatcggcccccagggatttctgatcgcttctctggctccaagtctggcaacacggcctccctgaccatctctgggctccgggctgaggacgaggctcactattactgcagctcatatacaaccagcgacactctgttgttcggcggagggactgaactgaccgtcctaggtcagcccaaggctgccccctggt

SEQ ID NO: 787983 - DNA, 441 bp, Homo sapiens
  misc_feature: NA.8.85.H08.1.454.light.4.nb
tcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtggggtcccatcaaggttcagtggcagtggatctgggacagatttcactctcaccatccgcagtctgcaacctgaagattttgctaatttattactgtcaagagactcacaatggaggcacttttggccaggggaccaagctggagaggaaacgaactgtggctgcaccatctgt

SEQ ID NO: 787984 - DNA, 450 bp, Homo sapiens
  misc_feature: NA.4.24.C02.1.454.light.4.nb
tagggaaagggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataacagttattggacgttcggccaagggaccaaggtggaaatcagacgaactgtggctgcaccatctgtcttcta

SEQ ID NO: 787985 - DNA, 490 bp, Homo sapiens
  misc_feature: NA.48.4.A04.1.454.light.4.nb
agggcacgaccggtgctcgatttagagtagtgatcaggggggagtcagtctcagtcaggacacagcatggacatgagggtccccgctcagctcctggggctcctgctactctggctccgaggtgccagatgtgacatccagatgacccagtctccatcatccctgtctgcatatgtgggggacagagtcaccatcacttgccgggcaagtcagagcattagtaggtatttaaattggtatcatcaaagaccagggatggcccctaacctcctgatctacggtacatccactttgcaaagtggggtcccctcaaggttcagcggcagtggctcttggacggatttcactctcaccatcaccagtcttcaggctgaagatttaggaatttactactgtcagcagacttacagtgttccgtacacttttggccaggggaccaaactggagatgaaacgaactgtggctgcaccatctgtcttcatcttccccg

SEQ ID NO: 787986 - DNA, 429 bp, Homo sapiens
  misc_feature: NA.52.8.A08.1.454.light.4.nb
aggggaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatcaagcgaactgtgg

SEQ ID NO: 787987 - DNA, 497 bp, Homo sapiens
  misc_feature: NA.10.9.A09.1.454.light.4.nb
aggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaagtggagatcaaacgaactgtggctgcaccatctgtcttcatcttcccgccatctgacactactatg

SEQ ID NO: 787988 - DNA, 530 bp, Homo sapiens
  misc_feature: NA.48.36.D03.1.454.light.4.nb
atctctcttgggaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaaccccactgtcactctgttcccaccctcctctatgtatact

SEQ ID NO: 787989 - DNA, 470 bp, Homo sapiens
  misc_feature: NA.43.46.E02.1.454.light.4.nb
aagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgaactactcaca

SEQ ID NO: 787990 - DNA, 457 bp, Homo sapiens
  misc_feature: NA.10.37.D04.1.454.light.4.nb
ttgggtttggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctccgtggacgttcggccaagggaccaaggtggacctcaaacgaactgtggctgcaccatctgtcttcta

SEQ ID NO: 787991 - DNA, 466 bp, Homo sapiens
  misc_feature: NA.15.26.C04.1.454.light.4.nb
tcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatcttcccgccatctgagctacgtaga

SEQ ID NO: 787992 - DNA, 477 bp, Homo sapiens
  misc_feature: NA.14.53.E09.1.454.light.4.nb
ttgggtttggggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggtctacc

SEQ ID NO: 787993 - DNA, 351 bp, Homo sapiens
  misc_feature: NA.12.78.H01.1.454.light.4.nb
acccccgggcagagggtcaccatctcttgttctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccaccctcctctacgtcgtat

SEQ ID NO: 787994 - DNA, 461 bp, Homo sapiens
  misc_feature: NA.15.57.F02.1.454.light.4.nb
ttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccgccctcctcgctacgtaga

SEQ ID NO: 787995 - DNA, 491 bp, Homo sapiens
  misc_feature: NA.41.16.B05.1.454.light.4.nb
agggcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgcagtttattactgtcaccaatataataactggtacacttttggccaggggaccaagctcgagatcaaacgaactgtggctgcaccatctgtcttcatcttcccgccta

SEQ ID NO: 787996 - DNA, 475 bp, Homo sapiens
  misc_feature: NA.49.8.A08.1.454.light.4.nb
agggcacgaccggtgctcgatttagcatactctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaactgtggctgcaccatctgt

SEQ ID NO: 787997 - DNA, 447 bp, Homo sapiens
  misc_feature: NA.12.11.A11.1.454.light.4.nb
gggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctgggagtgataagtttgtctcctggtaccaacatcacccaggcaaagcccccagactcatgatttatgagggcaaaaaacggccctcggggatttctaatcgcttctctggctccaagtctggcaacacggcctccctgacaatctctgggctccaggctgaggacgaggctgattattactgctgctcatatgcaggtagtggcactttcgcactattcggcggagggaccaagctgaccgtcctacgtcagcccaaggctg

SEQ ID NO: 787998 - DNA, 476 bp, Homo sapiens
  misc_feature: NA.51.80.H03.1.454.light.4.nb
aagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctattcggcggagggaccaagctgaccgtcctaggtcagcccaaggctgccccctcggtcactctgttccca

SEQ ID NO: 787999 - DNA, 444 bp, Homo sapiens
  misc_feature: NA.10.1.A01.1.454.light.4.nb
aggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtcagaccccg

SEQ ID NO: 788000 - DNA, 442 bp, Homo sapiens
  misc_feature: NA.41.73.G07.1.454.light.4.nb
agggcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaaggga

SEQ ID NO: 788001 - DNA, 431 bp, Homo sapiens
  misc_feature: NA.48.56.F01.1.454.light.4.nb
aacacacaaaggggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcgtacgttcggccaagggaccaaggtggaaatcaaacgaa

SEQ ID NO: 788002 - DNA, 448 bp, Homo sapiens
  misc_feature: NA.9.77.G11.1.454.light.4.nb
aagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaagcccctaaactcctgatgtattatgcgtctagattagaaagtggggtcccatcaaggttcagcggcagccaatctgggacagacttcactctcaccatcaccagtctgcagcctgatgacttcgcaagttattactgccaacagtacagaatttatccgtggacattcggccaagggaccaaggtggaaatcaaacgaactgtggctgcaccatctgtt

SEQ ID NO: 788003 - DNA, 469 bp, Homo sapiens
  misc_feature: NA.41.28.C06.1.454.light.4.nb
aaaaggccctgaggaagacaaaccccagctgtgaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgacctcaggctcagtctctcctagtaattacgccagctggtaccagcagaccccaggccagcctccacgcatcctcatctactacacggacactcggtcttctggggtccctgatcgcttctctggctccatccttgggaacaaagctgccctcaccatcacgggggcccaggcagatgatgaatctgattattactgtgcgctatttgtgtataacgtcaattgggtctttggcggagggaccaagctgaccgtcctacgtcagcccaa

SEQ ID NO: 788004 - DNA, 450 bp, Homo sapiens
  misc_feature: NA.26.60.F05.1.454.light.4.nb
gggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgctagtttattactgtcagcagtatcatgactggccgctcaccttcggccaagggacacgactggagattaaacgaactgtggctgcaccatcgttcg

SEQ ID NO: 788005 - DNA, 463 bp, Homo sapiens
  misc_feature: NA.48.16.B05.1.454.light.4.nb
agggggggtcacaagaggcagcgctctcgggacgtctccaccatggcctgggctctgctgctcctcactctcctcactcaggacacagggtcctgggcccagtctgccctgactcagcctgcctccgtgtctgggtctcctagacaatcgattaccatctcctgcactggaaccagcagtgatattgggagtcataaccttgtctcctggtatcaacaatatccaggcagagccccccaactcataatttatgcggcctctcagcggcccccaggggtttccagtcgcttctctgcctccaagtctggcaacacggcctccttgacaatctctggcctccagcctgaggacgaggctgactattactgctgctcatatacaactatgaatgcttttttgttcggcggagggaccaaactgaccgtcctcggtcggcccaaggctgccccctcggtcactctcg

SEQ ID NO: 788006 - DNA, 462 bp, Homo sapiens
  misc_feature: NA.16.49.E05.1.454.light.4.nb
aacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggcggagggaccaaggtgaccgtcctaggtcagcccaaggctgccccccg

SEQ ID NO: 788007 - DNA, 449 bp, Homo sapiens
  misc_feature: NA.21.65.F10.1.454.light.4.nb
aggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcggccaagggaccaaggtggaaatcaaacgaactgtggctgcaccatctgtcttcta

SEQ ID NO: 788008 - DNA, 479 bp, Homo sapiens
  misc_feature: NA.52.67.G01.1.454.light.4.nb
ttgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcggggtggaggctgaggatggttggggtttattactgcatgcaaggtacacactggcctccgacgttcggccaagggaccaaggtggaaatcaaacgaactgtggctgcaccatctgtcttcatcttccccg

SEQ ID NO: 788009 - DNA, 449 bp, Homo sapiens
  misc_feature: NA.15.67.G01.1.454.light.4.nb
ttgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggccagggaccgaacggtggaaagtacaaacgaactagtggctgcacc

SEQ ID NO: 788010 - DNA, 470 bp, Homo sapiens
  misc_feature: NA.5.60.F05.1.454.light.4.nb
gggaaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggctgccccctcggt

SEQ ID NO: 788011 - DNA, 486 bp, Homo sapiens
  misc_feature: NA.40.8.A08.1.454.light.4.nb
agggggctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagactgttttatacagctccaacaatgagaactacgttgcttggtaccagcagaaaccaggacagcctcctaagttgctcatttactgggcatctacccgggcatccggggtccctgaccgattcagtggcagcgggtctgggacagatttcactctcaccatcaacaacctgcaggctgaagatgtggcagtttattactgtcaacaatattatactactccgctcactttcggcggaggcaccaaggtggagatcagacgaactgtggctgcaccatctgtcttcatcttcccgccatctgaagtcgctaga

SEQ ID NO: 788012 - DNA, 473 bp, Homo sapiens
  misc_feature: NA.17.37.D04.1.454.light.4.nb
ttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtccttggtcagcccaaggctgccccctcggtcactctgttcccaccct

SEQ ID NO: 788013 - DNA, 459 bp, Homo sapiens
  misc_feature: NA.52.86.H09.1.454.light.4.nb
ttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 788014 - DNA, 440 bp, Homo sapiens
  misc_feature: NA.22.65.F10.1.454.light.4.nb
agggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggccaagggacacgactggagattaaacgaactgtggctgcaccatc

SEQ ID NO: 788015 - DNA, 478 bp, Homo sapiens
  misc_feature: NA.10.28.C06.1.454.light.4.nb
tctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtggttcggcgggggaccacactgaccgtcctaggtcagcccaaggctgccccctcggtcactctgttcccaccctcctccactactatg

SEQ ID NO: 788016 - DNA, 450 bp, Homo sapiens
  misc_feature: NA.49.48.E04.1.454.light.4.nb
ctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtactggtcatctacgaggacagtaaacgaccctccgggatccctgcgagattctctgcctctagttcagggacaatggccaccttgactatcagtggggcccaggtggaggatgaagctgactactattgttactcaacagacagcagtgccgagggggtcttcggcggagggaccaagctgaccgtcctaggtcagcccaaggctgccccctcggtcactctgtt

SEQ ID NO: 788017 - DNA, 481 bp, Homo sapiens
  misc_feature: NA.9.38.D05.1.454.light.4.nb
ttgagtttggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcgggggaccaaggtgaccgtcctaagtcagcccaaggctgccccctcggtcactctgttcccaccctcctcacg

SEQ ID NO: 788018 - DNA, 474 bp, Homo sapiens
  misc_feature: NA.8.23.C01.1.454.light.4.nb
tagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagcccaaggccaaccccactgtcactctgttcccaccctcctcgac

SEQ ID NO: 788019 - DNA, 490 bp, Homo sapiens
  misc_feature: NA.40.86.H09.1.454.light.4.nb
ttgggtttgggcacgaccgggtgctcgatttagtgctatagacttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccggactgttctatacagcttcaacaataagaactctgtggcttggtaccagcacaaaccaggacagcctcccaagctgctcattgactgggcatctacccggggatccggggtccctgaccgattcagtggcagcgggtctgggacagatttcactctcaccatcaccagcctgcaggctgaagatgtggcggtttattactgtcaacaatattctggtcaatctcattctttcggcggagggaccaaggtggagatcagacgaactgt

SEQ ID NO: 788020 - DNA, 446 bp, Homo sapiens
  misc_feature: NA.5.34.D01.1.454.light.4.nb
ttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaagggacacgactggagattaaacgaactagtggctgcacc

SEQ ID NO: 788021 - DNA, 442 bp, Homo sapiens
  misc_feature: NA.4.42.D09.1.454.light.4.nb
agggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccagcagaaacctggccaggctcccaggctcctcattcatggtgcatctaacagggccgatggcatcccagccaggttcagtggcagtggatatgggacagacttcactctcaccatcagcagtctgcagtctgaagattttgcagtttatttctgtcagcagtttaacacctggcctggaagttttggccaggggaccaagctggagctcaaacgaactgtggctgcacc

SEQ ID NO: 788022 - DNA, 452 bp, Homo sapiens
  misc_feature: NA.13.39.D06.1.454.light.4.nb
cagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaact

SEQ ID NO: 788023 - DNA, 464 bp, Homo sapiens
  misc_feature: NA.8.55.E11.1.454.light.4.nb
ttgggtttggggagctctgcttcagctgtgagcgcagaaggcaggactcgggacaatcgtcatcatgacctgctcccctctcctcctcacccttctcattcactgcacagggtcctgggcccagcctgtgttgacgcaggcgccctcagtatctgcggccccgggacagagggtcaccatctcctgctccggaagcacctcaaatattggggacagttttgtatcgtggtatcagcaagtccccggaacagcccccaaactcctcatttatgaggataatgagcgacgttcaggaattcctgaccgtttctctggctccaagtctggcacgtcagccaccctgggcatcaccggactccagactggggacgaggccgactattactgcggagcatgggatagcagcctgaacactgtggtcttcggcggagggaccaagctgaccgtccttagtcagcccaagg

SEQ ID NO: 788024 - DNA, 458 bp, Homo sapiens
  misc_feature: NA.43.6.A06.1.454.light.4.nb
agggggctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccagggtctttcatacaacttatatgaatatttggcctggttccagcagaggcccggccgctctccaagacttctcctgtctggggcttgtcatcgggaagccggagtccctgaccgcttctctggcggcggctctggaagaaacttcactctcaccatctctgccctggagactgatgacgtggctacttattactgtcaacagtgttatggcgttcccatcaccttcggcgggggaccgagaatcgacatcagacgaactgtggctgcaccatctgtcttcatctt

SEQ ID NO: 788025 - DNA, 472 bp, Homo sapiens
  misc_feature: NA.40.14.B03.1.454.light.4.nb
tccgcggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgttccc

SEQ ID NO: 788026 - DNA, 454 bp, Homo sapiens
  misc_feature: NA.41.27.C05.2.454.light.4.zerom50
agggtttggggctgggcctcaggaagcagcatcagcagtgcctcagccacggcctggacccctctcctcctcggcctcctcgctcactgcacagtcttcacagagtctgcgacgtcgtgtgaggtgactccggcacactcagtgtcagtggccacagtacagatggccaggatcacctgtgggggaggctacttggaagtaaacctgtgcacttgtaccggcaaaaggcaggccaggaccctgttgtggtcatatataatgaaacttatggccgttcagggatccctgagtgcgtctctggctccaagtcagggaacaccagcaccctatgtattggcaggatcgaggctggcgatgaggctgcatatttatgtcaggtgtgggacagtaatagtgatctgggtgttcggcggagggaccacggctggaccgtcctaggtcagcccaaggctcg

SEQ ID NO: 788027 - DNA, 471 bp, Homo sapiens
  misc_feature: NA.13.19.B08.1.454.light.4.zerom50
aagggggtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaatatgctcggtggttccagcagaagccaggccaggccccagtactggtgatttataaagacattgagcggccctcagggatccctgagcgattctccggctctaattcagggaccacagtcaccttgaccatcaccggggcccagattgaggatgaggctgactattattgttactctgcggctgacaaccatctggttttcggcgggggaccaagttgaccgtcgtgggtcagcccaaggctgccccctcggtcactctcgttcccgaccctcctctagtaacg

SEQ ID NO: 788028 - DNA, 440 bp, Homo sapiens
  misc_feature: NA.48.45.E01.6.454.light.4.zerom50
agtcagacccagtcaggacacagcatggacatgagggtccccgctcagctcctggggctcctgctgctctggctcccaggtgccaaatgtgacatccagatgacccagtctccttccaccctgtctgcctctgtaggagacagggtcaccatcacttgccgggccagtcagagtattagtgactggttggcctggtatcagcagaaaccagggaaagcccctaacctcctgatctatcaggcatctactttagaaagtggggtcccatcaaggttcagcggcagtggatctgaaacagaattcactctcaccatcagcagcctgcagcctgatgattatgcgacttattactgccaacaatacactagtttgtggacgttcggccaggggaccaaggtggaaatacaaacgaaactgtggctgcaccatctgtcttcatt

SEQ ID NO: 788029 - DNA, 447 bp, Homo sapiens
  misc_feature: NA.52.3.A03.1.454.light.4.zerom50
aggggggagtcagacccagtcaggacacagcatggacatgagggtccccgctcagctcctggggctcctgctgctctggctcccaggtgccaaatgtgacatccagatgacccagtctccttccaccctgtctgcatctgttggagacagagtcaccatctcttgccgggccagtcagagtattagtacctcgttggcctggtatcagaagaaaccagggaaagcccctaaactcctgatctctaaggcatctgatttacaaactggggtcccgtcaaggttcagcggcagtggatctgggacagacttcactctcaccatcagcagcctgcagcctgatgactttgcaagttattattgccaacagtataacagtttttcattcacttttggccctgggacgacagtggatatcaaacgaactgtggctgcaccatctgtcttcta

SEQ ID NO: 788030 - DNA, 453 bp, Homo sapiens
  misc_feature: NA.52.70.G04.2.454.light.4.zerom50
ctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgmtatgcttattggtaccagcagaagccaggccaggcccctgtgttggtgatatataaagacactgagaggccctcagggatccctgagcgattctctggctccacctcagggacaatggtcacattgaccatcagtggagtccaggcagaggacgaggctgactattactgtcaatcaacagacaycagtggtacttatgtcttcggaactgsgaccaaggtcaccgtcctaggtcagcccaaggccaaccccactcgtcactcttcgcg

SEQ ID NO: 788031 - DNA, 463 bp, Homo sapiens
  misc_feature: NA.41.24.C02.2.454.light.4.zerom50
tagggaaaggggykgggcctcaggaagcagcatcggaggtgcctcagccatggcatggatccctctcttcctcggcgtccttgcttactgcacaggatctgtggcctcctttgagctgactcagccaccctcagtgtccgtgtccccaggacagacagccagcatcacctgctctggagatraattgssrarkmaatwtgyttacytggtaccagcagaagccagcccaggccccctgtgttggtgatgtataaagacaagtgagaggccctcagggatcccttgagcgattctctggcgccagctcaggaacagtagtcacgttgaccatcagtggagtccaggcagaagacgaggctgactattattgtcaagcagtagacagcagtggtccttagtcgggtggttcggcggggggaccrargcgtgaccgtcctaggtcagcccaacggctgccscctcc

SEQ ID NO: 788032 - DNA, 463 bp, Homo sapiens
  misc_feature: NA.53.73.G07.1.454.light.4.zerom50
argggggggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatgggacagcgaaattgcggtggttcgggcgggggaccaaacgtgaccgtcctaggtcagcccaaggctcgccccctcggtcactctcgtyccrccctt

SEQ ID NO: 788033 - DNA, 458 bp, Homo sapiens
  misc_feature: NA.41.20.B09.1.454.light.4.zerom50
agggggagtcagacccagtcaggacacagcatggacatgagggtccccgctcagctcctggggctcctgctgctctggctcccaggtgccaaatgtgagatccagatgacccagtctccttccaccctgtctgcatctgttggagacacagtcaccatcacttgccgggccagtcagtatattaatgactggttggcctggtatcagcagaaaagagggagggccccaaagctcctgatttacaaggcaggctatttagaaaatggggccccatcaagatttagtggctttggaactgggacggagttcactctcaccatcaccggcctgcagcctgatgactttgcaacttattactgccagcaatatgacgtttacccgctcactttcggcggagggaccaaggtggagatcaaaggaactgtggctgcaccatctgtcttcatcttcccgcctac

SEQ ID NO: 788034 - DNA, 454 bp, Homo sapiens
  misc_feature: NA.43.45.E01.3.454.light.4.zerom50
agtcagtctcagtcaggacacagcatggacatgagggtccccgctcagctcctggggctcctgctactctggctccgaggtgccagatgtgacatccagttgacgcagtctccatcctccctgtctgcatctgtgggagacagactcaccatcacttgccgggcaagtcagaccattaggacctatttaaattggtatcaggagaacccagggaaagcccctaagctcctgatctatgctacttccactttgcaaagtggggtcccatctaggttcagtggcagtggatcgggggacacatttcactctcaccatcagtagtctgcaacctgaagattatgcaacttacttctgtcaacagaagtgacagaaacccgtggacgttcggccaagggaccaasggtggaaagacaaacgaactagtggctgcaccatctcgtcttcatcttccccg

SEQ ID NO: 788035 - DNA, 459 bp, Homo sapiens
  misc_feature: NA.40.28.C06.4.454.light.4.zerom50
aaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatggtggggggtgccacgttgggtgttcggcggagggaccaagctgaccgtccg

SEQ ID NO: 788036 - DNA, 480 bp, Homo sapiens
  misc_feature: NA.49.1.A01.1.454.light.4.zerom50
aaggraaggaagggaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcactcaccatctcctgcactggtggttataactctgtctcctggtaccaacagcacccaggcaaagcccccaaactcatgatttatgaggtcaataggcggccctcaggggtccctgatcgcttctctggctccaagtctggcaccacggcctccctgaccgtctctgggctccaggcagaggatgaggctgattattactgcagctcatctgcaggcattaactaattttaatgttggtattcggcggagggaccaagctgaccgtcctaggtcagcccaaggctcgccccctcggtccactctcgttccccgt

SEQ ID NO: 788037 - DNA, 450 bp, Homo sapiens
  misc_feature: NA.12.8.A08.2.454.light.4.zerom50
aacacacgaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcaccta

SEQ ID NO: 788038 - DNA, 444 bp, Homo sapiens
  misc_feature: NA.22.25.C03.1.454.light.4.zerom50
ccaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaaactggtgtcccatcaaggttcagcggcagtggatctgggacagaattcactctcgccatcagcagcctgcagcctgatgattctgcaacttattactgccaacagtattatagttatcgggggacgttcggccaagggaccaaggtggaaatcaaacgaactgtggctgcaccatctgtttcta

SEQ ID NO: 788039 - DNA, 452 bp, Homo sapiens
  misc_feature: NA.48.21.B10.2.454.light.4.zerom50
agggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgcccctcctcatctataagtcctcaactttagagagtggggtcccatcaagattcagcggcagtggatctggaacagaattcactctcaccatcagcggcctgcagtctgatgattttgctaacttatttctgccaacagtatcatacttattctcggaccttcggccaagggaccagggtaggaaagtacaaacgaactagtggctgcaccatctgtcttcta

SEQ ID NO: 788040 - DNA, 472 bp, Homo sapiens
  misc_feature: NA.48.18.B07.1.454.light.4.zerom50
aggggggggtcacaagaggcagcgctctcgggacgtctccaccatggcctgggctctgctgctcctcactctcctcactcaggacacagggtcctgggcccagtctgccctgactcagcctgcctccgtgtctgggtctcctagacaatcgattaccatctcctgcactggaaccagcagtgatattgggagtcataaccttgtctcctggtatcaacaatatccaggcagagccccccaactcattaatttatgcggcctctcagcggcccccaggggtttccagtcgcttctctgcctccaagtctggcaacacggcctccttgacaatctctggcctccagcctgaggacgaggctgactattactgctgctcatatacaactatgaatgtcttttttgttcggtcggagggaccaaactgaccgtcctcggtcggcccaaggcctcgccccctcggtccactcttccg

SEQ ID NO: 788041 - DNA, 459 bp, Homo sapiens
  misc_feature: NA.52.54.E10.2.454.light.4.zerom50
aacacacaaagggggctgtgggctcagaagcagagttctggggtgtctccaccatggcctggacccctctctggctcactctcctcactctttgcataggttctgtggtttcttctgagctgactcaggaccctgctgtgtctgtggtcttgggacagacagtcaggatcacatgccaaggagacagcctcagaaacttttatgcaagttggtaccaacagaagccaggacaggcccctgtagctgtcatatatggtggaatctatcggccctcagggatcccagaccgattctctggctccagttcaggaaacacagcttccttgaccatcactggggctcaggcggaagatgaggctgactattattgtaactcccgggacagcagtagtaatctcattgtgttcggcggagggaccgaggctgaccgtcctaggtcagcccaaggcctgccccccg

SEQ ID NO: 788042 - DNA, 442 bp, Homo sapiens
  misc_feature: NA.43.51.E07.1.454.light.4.zerom50
cttcagctgtgggcacaagaggcagcactcaggacaatctccagcatggcctggtctcctctcctcctcactctcctcgctcactgcacagggtcctgggcccagtctgtattgacgcagccgccctcagtgtctggggccccagggcagagggtcaccatctcctgcactgggagcgcctccaacattgggacaggttatgatgtacactggtaccagcaccttccaggagcagcccccaaactcgtcatctatgctgacaacagtcggccctcaggggtccctgaccgattctctggctccaagtctggcacctcagcctccctggacatcactgggctccaggctgaggatgaggctgactattactgccagtgctatgacagcgacctgagcggttcgatcttcggcggagggacgaagctgaccgtcctaagtcacg

SEQ ID NO: 788043 - DNA, 444 bp, Homo sapiens
  misc_feature: NA.5.38.D05.1.454.light.4.zerom50
ttgggtttgggaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcagttgtcgggcgagtcagggtattagtacctggttagcctggtatcagcagaaaccagggaaagcccctaaactcctgatctatggtgcatcgagtttgcaaagtggggtcccatcaaggttcagcggcagtggatctgggacagatttcactctcaccatcagcagtctgcagcctgaagattttgcaacttactattgtcaacaggccatcagtatccctccgctcactttcggcggagggaccaaggtggagatcaaacgaactgtggctgcaa

SEQ ID NO: 788044 - DNA, 441 bp, Homo sapiens
  misc_feature: NA.40.84.H07.1.454.light.4.zerom50
aggaactgctcagttaggacccagacggaaccatggaagccccagcgcagcttctcttcctcctgctactctggctcccagataccactggagaaatagtgctgacgcagtctccagccaccctgtctgtgtctccaggggaaagaggcaccctctcctgcagggccagtcagagtgttgccaccaacttagcctggtaccagcagaaacctggccagcctcccaggctcctcatctatcgtgcatccaccagggccactggtatcccagccaggttcagtggcagtgggtctgggacagacttcactctcaccatcagcagcctgcagtctgaagattttgctagtttatttctgtcagcagtattataactgggtgctcactttcggcggaagggaccgaaggtggaggatcaagcgaactgtggctgcaccatcttcg

SEQ ID NO: 788045 - DNA, 453 bp, Homo sapiens
  misc_feature: NA.49.25.C03.3.454.light.4.zerom50
aagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctgcaagcaggtccaatattgcgaatgagtatgtttcctggtaccagcacctcccaggaacagtccccaaactcctcatttatgacaataataggcgaccctcagggattcctgaccgattctctggctccaagtctgccgcgtcagccaccctgggcatcaccggactccagactggggacgagggcgattattactgcgcaataggggatagaagtctgagtgctggcagggtgttcggcggagggaccaagctgaccgtctaggtcagacccg

SEQ ID NO: 788046 - DNA, 470 bp, Homo sapiens
  misc_feature: NA.40.58.F03.2.454.light.4.zerom50
aagggaaagggggagctgctcagttaggacccagagggaaccatggaaaccccagcgcagcttctcttcctcctgctactctggctcccagagacccccggagaaattgtgttgacgcagtctccaggcaccctgtctttgtctccaggggaaagagccaccctctcctgcagggccagtcagagtgtaaccaacaactacttaatgtggtaccagcaaaaacctggccaggctcccaggctcctcatctatggtgcatccaacagggccagtggcatcccagacaggtttagaggcagtggggccgacacagacttcactctcaccatcagcagactggagcctgaagattttgcactgtattactgtcaccagtctgctcacgtacctctcactttcggcggagggaccaaggtggagatacaaacgaactgtggctgcaccatctgtcttcgatccttcccgcctac

SEQ ID NO: 788047 - DNA, 461 bp, Homo sapiens
  misc_feature: NA.52.63.F08.1.454.light.4.zerom50
agggggctctgcttcagctgtgagcgcagaaggcaggactcgggacaatcttcatcatgacctgctcccctctcctcctcacccttctcattcactgcacagggtcctgggcccagtctggtttgacgcagccgccctcagtgtctgcggccccgggacagcaggtcaccatctcctgctctggaagcagacccagcagttgggagtaattatgtctcctggtaccagcagctcccaggaaccaacccccaaactcctcatctatgacaatgataagcgaccctcaggaattcctgaccgtattttctggctccaagtctggcaggtcagccaccctgggcatcaccggactccagactggcgacgaggccgattattactgcgcatcatgggatggcagcctaaacactgtggcattcgggcggagggaccaagttcgaccgtcctacggtcagaccccg

SEQ ID NO: 788048 - DNA, 469 bp, Homo sapiens
  misc_feature: NA.8.19.B08.1.454.light.4.zerom50
agggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactagtggctgcaccatctgtcttcatcttcccgccactcg

SEQ ID NO: 788049 - DNA, 438 bp, Homo sapiens
  misc_feature: NA.18.53.E09.1.454.light.4.zerom50
ttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaagcccctaagctcctgatctatgctacatccagtttgcaaagtggggtcccatcaaggttcagtggcagtggatctgggacagatttcactctcaccatcagcagtctgcaacctgaagattttgcaacttactactgtcaacagagttacagtacccgtcgtacttttggccagggaccaagctggagatcaaacgaactgtggctgcaccta

SEQ ID NO: 788050 - DNA, 309 bp, Homo sapiens
  misc_feature: NA.3.9.A09.1.454.light.4.zerom50
agggccagtcagactgttgtctccaactacttagcctggcaccaacagaggcctggccaggctcccaggctcctcatctatggtgcttccagcagggcccctggcatcccagacaggttcagtggcagtgggtctgggacagacttcactctcaccatcagcagactggagcctgaagatgttgctgtgtattactgtcatcagtataataactctccgctcactttcggcggagggaccaaagtggagctcagacgaactgtggctgcaccatctgtcttcatcttcccgccatctgagagtgcgtct

SEQ ID NO: 788051 - DNA, 430 bp, Homo sapiens
  misc_feature: NA.48.51.E07.1.454.light.4.zerom50
caggagtcagtctcagtcaggacacagcatggacatgagggtccccgctcagctcctggggctcctgctactctggctccgaggtgccagatgtgacatccagatgacccagtctccatcctccctgtctgcatctgtgggagacagagtcaccatcacttgccgggcaagtcagagcattagcagctatttaaattggtatcagcagaaaccagggaaagcccctaagctcctgatctatggtgcatccattttgcaaagtgggatcccatcagggttcagtggcagtgggtctgggacagatttcactctcaccatcagcagtttgcaacctgaagattttgcaacttactactgtcaacagagttacagtgacccgtacaattttggccaggggaccaagctggagatcaaacgaactgtggctacg

SEQ ID NO: 788052 - DNA, 437 bp, Homo sapiens
  misc_feature: NA.16.81.H04.1.454.light.4.zerom50
caagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactagtggctgcaccatctgtttc

SEQ ID NO: 788053 - DNA, 450 bp, Homo sapiens
  misc_feature: NA.48.40.D07.1.454.light.4.zerom50
taacaacagaggggctgatcaggactcctcagttcaccttctcacaatgaggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttgggttctaatcgggcctccggggtccctgacaggttcagtggccatggatcaggcacagatttcacactgaaaatcagcagagtggaggctgaggatgttggagtttactactgcatgcaagctctgcatactgctcggacgttcggtccaagggaccgaacggtaggaggatacaaacg

SEQ ID NO: 788054 - DNA, 437 bp, Homo sapiens
  misc_feature: NA.48.51.E07.4.454.light.4.zerom50
ctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatttcctgcactgggaccagctccaacatcggcgtaggttatgatgtacactggtaccagcaacttccaggaacagtccccagactcctcatctatgataacaacaatcggccctcaggggtccctgaccggttctctggctccaagtctggcacctcagccyycctggccatcactgggctccagactgaggatggaggctgattattactgccagtcctatgacagcaacctgagcggttgggtgttcggcggagggaccgagggtgtacccg

SEQ ID NO: 788055 - DNA, 459 bp, Homo sapiens
  misc_feature: NA.11.74.G08.1.454.light.4.zerom50
aaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacattggtggttataactatgtctcctggtaccaacaacacccagacaaagcccccaaactcatgatttatgaggtcactaagcggccctcaggggtccctgatcgcttctctggctccaagtctggcaacacggcctccctgaccgtctctgggctccaggctgacgatgaggctgattattattgcagctcatatgcaggcagcaccaatttggtgttcggcggagggaccaagctgaccgtcctaggtcagcccaaggctgccccctcggtcg

SEQ ID NO: 788056 - DNA, 450 bp, Homo sapiens
  misc_feature: NA.15.31.C09.1.454.light.4.zerom50
tctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaactcatgatttatgaggtcagtaatcggccctcaggggtttctaatcgcttctctggctccaagtctggcaacatggcctccctgaccatctctgggctccaggctgaggacgaggctgattattactgcagctcatatacaagcagcagcactccttgggtgttcggcggagggaccaagctgaccgtcctaggtcagcccaaggtcccgcccccttc

SEQ ID NO: 788057 - DNA, 446 bp, Homo sapiens
  misc_feature: NA.48.11.A11.2.454.light.4.zerom50
aagggggaggtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtccgagggaccgaaacgtaggagtgtcaaccgaacctgtggcgtgtcaccta

SEQ ID NO: 788058 - DNA, 431 bp, Homo sapiens
  misc_feature: NA.10.48.E04.1.454.light.4.zerom50
aggaactgctcagttaggacccagagggaaccatggaagccccagctcagcttctcttcctcctgctactctggctcccagataccaccggagaaattgtgttgacacagtctccagccaccctgtctttgtctccaggggaaggagccaccctctcctgcagggccagtcagagtgttagcatctacttagcctggttccaacagaaacctggccaggctcccaggctcctcatctataatgcatccaacagggccactggcatcccagccaggttcagtggcagtgggtctgggacagacttcactctcaccatcagcagcctagagcctgaagattttgcagtttattactgtcagcagcgtttcgcctggcctcacacttttggccaggggaccaagctggagatcatgcgaactgtggctgcacca

SEQ ID NO: 788059 - DNA, 467 bp, Homo sapiens
  misc_feature: NA.41.27.C05.1.454.light.4.zerom50
agggtttggggctgggcctcaggaagcagcatcggaggtgcctcagccatggcgtggatccctctcttcctcggcgtccttgcttcctgcacagtttccgtggcctcctcggaattgactcaggcaccctcagtgtccgtgtctccaggacagacagccagaatcacctgctctggagacacgttgggggagacatttgcttcctggtatcaacagaggccaggccagtcccctatcctggtcatctttcaggatgacaaacggccctctggcatccctgaacgcttctctggttccaggtcaggaaacagagccactctaaccatcaccgagacccaggctgtcgatgaggctgactattactgtcaggcctgggacagaaacactggcatattcggcggagggaccaagctgaccgtcctacgtcaggcccaaggctgccccctcggtcactctgttcccgccct

SEQ ID NO: 788060 - DNA, 469 bp, Homo sapiens
  misc_feature: NA.41.27.C05.4.454.light.4.zerom50
agggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccacgcctgaggacggaggctgactacttactgctcagcatgggacagcacgtcctctaatggttttgggtggtttcgggtcgggaggggaccaaggctcggaccgtccgtaggtcacgaccccg

SEQ ID NO: 788061 - DNA, 467 bp, Homo sapiens
  misc_feature: NA.41.27.C05.5.454.light.4.zerom50
agggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggwaccakcagygaygttgrtkrttataacywtgtctcctggtaccaacarcacccaggcaaagcccccaaactcmtgatttatgakgkcrrtmakcggccctcaggggtttctratcgcttctctggctccaagtctggcaayacggcctccctgacmrtctctsggctccaggckgaggacgaggctgattaytactgcwkctcatatrcaagcakmmkmastctckkggtrttcggcggagggaccaaggctgaccgtcctaggtcagcccaaaggctgccccctcggtc

SEQ ID NO: 788062 - DNA, 450 bp, Homo sapiens
  misc_feature: NA.47.77.G11.1.454.light.4.zerom50
aaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtactacttttggccaggggaccaaactggacatcaaacgaactgtggctgcaccatcttcg

SEQ ID NO: 788063 - DNA, 454 bp, Homo sapiens
  misc_feature: NA.41.82.H05.1.454.light.4.zerom50
agtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatctataaggcgtctagtttagaaagtggggtcccatcaaggatcagcggcagtggatctgggacagaattcactctcaccattagtagcctgcagcctgatgattttgcaacttattactgccaacaatataatgattttccgtggacgttcggccaagggaccaaggtagaaatacaaacgaactagtggctgcaccatctgtcttcatcttccccgccta

SEQ ID NO: 788064 - DNA, 448 bp, Homo sapiens
  misc_feature: NA.8.80.H03.1.454.light.4.zerom50
aaagggaaagggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctacttagcctggtatcagcagaaaccagggaaagcccctaacctcctgatccatactgcatccagcttgcaaagtggggtcccatcaaggttcagcggcagtggatctgggacagatttcactctcaccatcagcagcctgcagcctgaagattttgcaacttactattgtcaacaggctgccggtttcccttggacgttcggccaagggaccaaggtggaaatcaaacgaactagtggctgcaccatctgtt

SEQ ID NO: 788065 - DNA, 426 bp, Homo sapiens
  misc_feature: NA.26.72.G06.2.454.light.4.zerom50
tgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgaactgtggctgcaccatctgtcttcatcttcccgccatctgaagtatagtct

SEQ ID NO: 788066 - DNA, 464 bp, Homo sapiens
  misc_feature: NA.40.29.C07.2.454.light.4.zerom50
agggaaagggggaggaactgctcagttaggacccagagggaaccatggaagccccagctcagcttctcttcctcctgctactctggctcccagataccgccggagaaattgtgttgacacagtctccagccaccctgtctttatctccaggggaaagagccatcctctcctgcagggccagtcagaatattgatacatacttagcctggtaccagcagaaacctggcctggctcccagggtcctcatccatgatgcctcccacagggccactggcatcccacacaggttcagtggcagtgggtctggggacagacttcagtctcaccatcagcagcctagagcctgaggattttgcaatttatttctgtcaacagcgtagcacctggccccgggtcaccttcggccaagggacgacgactggacgatagaaacgaactagtggctgcaccactctgtcttcatt

SEQ ID NO: 788067 - DNA, 465 bp, Homo sapiens
  misc_feature: NA.18.22.B11.1.454.light.4.zerom50
aggggcagcaagatggtgttgcagacccaggtcttcatttctctgttgctctggatctctggtacctacggggacttcgtgatgacccagtctccagactccctggctgtgtctctgggcgagagggccaccatcaactgcaagtccagccagagtattttaaagaactccaacaatcagaattacttaacttggtatcagcagaaagcaggccagcctcccaagttgctcatttactgggcatcaacccgggaatccggggtccctgaccgattcagtggcagcgggtctgggacagacttcactctcaccatcagcagcctgcaggctgaagatgtggcagtttattactgtcagcagtattatagtactcctccgacgttcggccaagggaccaaggtggagattaaacgaactgtggctgcaccatctgtcttcatcttcccgccatctgacatactcgtc

SEQ ID NO: 788068 - DNA, 452 bp, Homo sapiens
  misc_feature: NA.52.69.G03.2.454.light.4.zerom50
cagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaggcggctccaacatcggagggaatactgtgaactggtaccagcaactcccagggacggcccccagactcctcatctttagtcataatcagcggccctcaggggtccctgaccgattctctggctccaagtctggcacctcagcctccttggccatcagtgggctccagtctgacgatgaggctgattacttctgtgcaacttgggatgacagcctgaatggtccggtgttcggcggagggaccaagcttaccgttctgggtcagcccaaggctcg

SEQ ID NO: 788069 - DNA, 456 bp, Homo sapiens
  misc_feature: NA.4.20.B09.1.454.light.4.zerom50
agggggagctacaacaggcaggcaggggcagcaagatggtgttgcagacccaggtcttcatttctctgttgctctggatctctggtgcctacggggacatcgtgatgacccagtctccggactccctggctgtgtctctgggcgagagggccaccatcaactgcaagtccagccagagtgttttatacaactccaacaataagaactacttagcttggtaccagcagagaccaggacagcctcctaagctgctcatttactgggcatctacccgggaatccggggtccctgaccgattcagtggcagcgggtctgggacagatttcactctcgccatcagcagcctgcagcctgacgatgtggcagtttattactgccagcaatattatactgacccgtggacgttcggccaagggaccaaggtggaaatacaaacgaactgtggctgcaccaytc

SEQ ID NO: 788070 - DNA, 454 bp, Homo sapiens
  misc_feature: NA.53.29.C07.2.454.light.4.zerom50
agggaaagggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatgtcctgcactgggaccagttccaacatcggggcagattatgatctacactggtatcagcaagttccaggaaccgcccccaaactcctcatctatggtaacaccaatcgaccctcaggggtccctgaccgattctctgcctccaagtctggcacctcagcctccctggccatcactgggctccagcctgaggatgaggctatttattactgccagtcctatgacaccagcctgagtggatcggtgttcggcggagggaccaaactgaccgtcctacg

SEQ ID NO: 788071 - DNA, 487 bp, Homo sapiens
  misc_feature: NA.52.62.F07.1.454.light.4.zerom50
aagggaaaggggctgggcctaaggaagcagcactggtggtgcctcagccatggcctggaccgttctcctcctcggcctcctctctcactgcacaggctctgtggcctcctctgtggtgacacagccaccctcggtgtctgtggccccgggaaagacggcctcaataacctgtgagagagacaacattgaaagaagacatgtacactggtaccagctgaggcccggccaggcccccagattggtcctctataatgatgacgaccggccctcagggatccctgagcgcttttctggctccaattctgggaacacggctaccctgaccatcactagggtcgaagccggggacgaggccgactattactgtcaggtgtgggatagtaatactgatcaatatgtcttcggaactgggaccacggtcaccgtcctaagtcagcccaaggccaaccccactgtcactctgttcccaccctcctctatacgatcg

SEQ ID NO: 788072 - DNA, 456 bp, Homo sapiens
  misc_feature: NA.52.62.F07.2.454.light.4.zerom50
aagggaaagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgcttctctggctccacctcagggacaatggtcacattgaccatcagtggagtccaggcagaagacgaggctgactattwctgtcaatcttcagacatcagtggtacttatgtcttcggaactgggaccaaggtcaccgtcctaggtcagcccaaggcccaacccactgtca

SEQ ID NO: 788073 - DNA, 348 bp, Homo sapiens
  misc_feature: NA.21.40.D07.1.454.light.4.zerom50
taacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtcctaggtcagcccaaggctgccccctcggtcactctgttcccaccctcctccgagcgacga

SEQ ID NO: 788074 - DNA, 427 bp, Homo sapiens
  misc_feature: NA.43.49.E05.2.454.light.4.zerom50
aacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacactcactctcacctgtgactccagcactggaactgtcaccagtggtcatttttcccactggttccaacagaagcctggccaagcccccaggacactgatttttgatgcagacaacagacactcctggacacctgcccgattctcaggctccctccttggggacaaggctgccctgcccctttcgggtgcggcagagggaccaccctgcccttccttagtcagcccaaggctgccccctcggtcactctgttcccrccctcctcactactcaca

SEQ ID NO: 788075 - DNA, 440 bp, Homo sapiens
  misc_feature: NA.43.78.H01.3.454.light.4.zerom50
cagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaactttcggtcaggggaccaagttgaacatcaatcgaactgtggctgcaccatctgtt

SEQ ID NO: 788076 - DNA, 456 bp, Homo sapiens
  misc_feature: NA.43.78.H01.4.454.light.4.zerom50
ctggggtctcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattattgctgctcatatgcaggtagttabacttatgtcttcggaadtgggacgacggtcaccgtcctaggtcagcccaaggccvaccccycacttcg

SEQ ID NO: 788077 - DNA, 464 bp, Homo sapiens
  misc_feature: NA.43.49.E05.1.454.light.4.zerom50
aacacacaaagggggaagagctgctcagttaggacccagagggaaccatggaaaccccagcgcagcttctcttcctcctgctactctggctcccagataccaccggagaaattgtgttgacgcagtctccaggcaccgtgtctttgtctccaggggaaagagccaccttctcttgcagggccagtcagagtgttagcagcaactacttagcctggtaccagcagaaacctggccaggctcccaggctcctcatctatggtgcatccaccagggccactggcatcccagacagattcagtggcactgggtctgggacagacttcactctcaccatcagcagactggaacctgaagattttgcaatttattactgtcagcagtatgcctggtcgcctccggccctcactttcggcggagggaccaaggtggagatcaaacgaactgtggctgcacctatctgttcg

SEQ ID NO: 788078 - DNA, 437 bp, Homo sapiens
  misc_feature: NA.52.2.A02.1.454.light.4.zerom50
agggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaactgtggctgcaa

SEQ ID NO: 788079 - DNA, 487 bp, Homo sapiens
  misc_feature: NA.48.84.H07.1.454.light.4.zerom50
tgagggtttagaacctatgaacattctgtctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctcgttccctacctcct

SEQ ID NO: 788080 - DNA, 435 bp, Homo sapiens
  misc_feature: NA.48.84.H07.2.454.light.4.zerom50
ctccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgaccgtcctaggtcacg

SEQ ID NO: 788081 - DNA, 466 bp, Homo sapiens
  misc_feature: NA.52.46.E02.1.454.light.4.zerom50
ctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataattctgtctcctggtaccaacaataccccggcaaagtccccaaactcatgatctttgaggtcaatgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccagactgaccgtcctacgtcagcccaaggctgccccctcggtctacctcttccgg

SEQ ID NO: 788082 - DNA, 458 bp, Homo sapiens
  misc_feature: NA.19.22.B11.1.454.light.4.zerom50
aaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttatacaactccaataataagaactacttagcttggttccagcagaaaccaggacagcctcctaagatgctcttttattgggcatctgcccgggaatccggggtccctgaccgattcagtggcagcgggtctgggacagatttcactctcaccatcagcggcctgcaggctgaagatgtggcagtttattactgtcagcaattttatagtactccctggacgttcggccaagggaccaaggtggaaatcaaacgaactgtggctgcaccatctgtcttcatcttcccgccatctgacg

SEQ ID NO: 788083 - DNA, 450 bp, Homo sapiens
  misc_feature: NA.40.70.G04.2.454.light.4.zerom50
tctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactccccatgtggtattcggcggagggaccaagctgaccgtcctaggtcagcccaaggctgccccccg

SEQ ID NO: 788084 - DNA, 436 bp, Homo sapiens
  misc_feature: NA.19.77.G11.1.454.light.4.zerom50
aagggaaagggtgacatccctcactgtggctcacgttcggcggagggaccgaggtggagatcaaacgtaagtgcactatccgaatgctttttgttataaggttttgatttggaggggttttgtgtttgagatatgaggtcaggtcaattccaaagagtaccagattctttcagaaagtcagatgagtaagggacagaaacttagttcatcttaaggaacagccaagcgctagccagttaagtgaggcatctcaattgcaagattttctctgcatcggtcaggttagtgatattaacagagaaaagagatttttgttaaggggaaagtaattaagctaacactgtggatcaccttcggccaagggacacgactggagattaaacgaactgtggctgcaccatctgtcttcatcttcccgccatctgacacgagagta

SEQ ID NO: 788085 - DNA, 480 bp, Homo sapiens
  misc_feature: NA.48.20.B09.2.454.light.4.zerom50
aggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctcgccccctcggtcactctcgttccccaccctt

SEQ ID NO: 788086 - DNA, 472 bp, Homo sapiens
  misc_feature: NA.51.44.D11.2.454.light.4.zerom50
agggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtggttcggcggagggaccaagctgaccgtcctaggtcagcccaaggctgccccctcggtcactctgtt

SEQ ID NO: 788087 - DNA, 474 bp, Homo sapiens
  misc_feature: NA.11.1.A01.1.454.light.4.zerom50
aaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactcgtcacttccg

SEQ ID NO: 788088 - DNA, 456 bp, Homo sapiens
  misc_feature: NA.48.45.E01.2.454.light.4.zerom50
aagagctgctcagttaggacccagagggaaccatggaaaccccagcgcagcttctcttcctcctgctactctggctcccagatascaccggagaaatygtgttgacgcagtctccaggcaccctgtctktgtctccaggggaaagagccaccctctcctgcagggccagtcagagtgttagcagcarctacttagcctggtaccagcagaaacckggccaggctcccaggctcctcatctayggtgcatccagcagggccactggcatcccagacaggttcagtkgcagtgggtctgggacagacttcactctcaccatcagcagactggagcctgaagattttgcartttattactgtcagcagtatggtacctcacccaggtacactttyggccargggaccaagctggagatcaaacgaactgtggctgcaccatctgtcttcatcttccccg

SEQ ID NO: 788089 - DNA, 435 bp, Homo sapiens
  misc_feature: NA.48.45.E01.3.454.light.4.zerom50
ctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcaggggtccctgctcgcttctctggctccaagtctggcaacacggcctccctgaccatctctgggctccaggctgaagatgaggctgattatttctgctgctcatatgcagccaactattatgtcttcggaactgagaccaaggtcaccgtcctaggtcagacccc

SEQ ID NO: 788090 - DNA, 448 bp, Homo sapiens
  misc_feature: NA.48.45.E01.4.454.light.4.zerom50
catgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtactttttagtttacgtcggaccttcggccaagggacacgactggagattaaacgaactgtggctgcaccatctgtcttcatcttcccg

SEQ ID NO: 788091 - DNA, 460 bp, Homo sapiens
  misc_feature: NA.48.45.E01.5.454.light.4.zerom50
agcctagctgtgctgtgggtccaggaggcagaactctgggtgtctcaccatggcctgggtccccctacttctccccctcctcactctctgcacaggctctcaggcctcctatgagttgacacagccaccctcggtgtcagtgtccccaggacagacggccaggatcacctgctctggagatggattgccaacacaatatgcgtactggtaccagaagaagccaggccaggcccctgttttggtgatatatcaagacactcagagggcctcagggacccctgagcggttctctggctccagctcaggggcaacagtcgcgttgacaatcagggaagtccaggcagaggacgaggctgactattactgtcagtctgcagacaacggaggtacttacttggtcttcggcggagggaccaagttgaacgtcctgggtcagcccaaggctgbcccctcggtctac

SEQ ID NO: 788092 - DNA, 447 bp, Homo sapiens
  misc_feature: NA.8.49.E05.1.454.light.4.zerom50
aacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtggggtcccatcaagattcagtggcggtggatctgggacagatttcactctcaccatcaacagtctgcagattgaggattatgcaacttattactgtcagcagagttccaggaccccgctcactttcggcggggggaccaaagtggacgtcaaacgaactgtggctgcacctact

SEQ ID NO: 788093 - DNA, 462 bp, Homo sapiens
  misc_feature: NA.40.17.B06.1.454.light.4.zerom50
agagggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatctataaggcgtctagtttagaaagtggggtcccatcaaggatcagcggcagtggatctgggacagaattcactctcaccattagtagcctgcagcctgatgattttgcaacttattactgccaacaatataatgattttccgtggacgttcggccaagggaccaaggtagaaatcaaacgaactagtggctgcaccatctgtcttcatcttcccgcctact

SEQ ID NO: 788094 - DNA, 445 bp, Homo sapiens
  misc_feature: NA.40.17.B06.2.454.light.4.zerom50
agggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctcagctcctgatctatactgcatccactttacaaagtggggtcccatcaaggttcagcggcagtggatctggcacagatttcactctcaccatcagcagcctgcagcctgaagattttgcaacttattactgtctacaagattacaattaccctcggwackttyggccaggggaccgsgctggagatcaaacgaacctagtggcgtgcaccatctgtt

SEQ ID NO: 788095 - DNA, 490 bp, Homo sapiens
  misc_feature: NA.4.49.E05.1.454.light.4.zerom50
aacacacaaagggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactcccccattttacgtcatgtatcaaacttcgaggcgcccctcaggagtccctgaacgcttttcgggctccaagtctggggacacagccactctgactattaccggggcccaggccatcgatgagggagacttttactgtcaggcgtgggacagcacaacttccatcttcggcggagggacacgggatggaccgtcctgggtcacgcccaagggctcgccccctcggtcactctcgttccccgccctcctcctactacg

SEQ ID NO: 788096 - DNA, 483 bp, Homo sapiens
  misc_feature: NA.53.80.H03.2.454.light.4.zerom50
aagggaaaggggctgggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaaagtgtgcactggtaccagcagatgccaggccaggcccctgtgttggtcgtctatgatgatrgcgaccggccctcaggggtccctgagcgattctctggctccaactctgggaacacggccaccctgaccataagcagggtcgaagccggggatgaggccgactattactgtcaggtgtgggatactagtagtgatcatccttgggtgttcggcggtgggaccaggctgaccgtcctaggtcagcccaaggctgccccctcggtcactctgttcccrccctcctctcg

SEQ ID NO: 788097 - DNA, 500 bp, Homo sapiens
  misc_feature: NA.53.80.H03.1.454.light.4.zerom50
aagggaaaggggagcttcagctgtggtagarrrgamaggrttcaggacaatctccagcatggccggcttccctctcctcctcaccctcctcactcactgtgcagggtcctgggcccagtctgtgctgactcagccaccctcagcgtctggggcccccgggcagacagtcaccatctcttgttctggcggcagctccaacatggggcctaactatgcttactggtaccagcagttcccaggagcggcccccaaactcctcatctataggaataatcagcggccctcaggggtccctgaccgattctctggctccaagtctggcacctcagcctccctggccatcagtgggctccggtccgaggatgaggctgattattactgtgcaacatgggatgacagcctgaggcggggtgttcggcggagggaccaagctgaccgtcctcggtcagcccaaggctgccccctcggtcactctgttcccrccctcctctcgtactgcg

SEQ ID NO: 788098 - DNA, 441 bp, Homo sapiens
  misc_feature: NA.21.46.E02.1.454.light.4.zerom50
tgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtcaaacagtagacagtagaggtactcattgggtgttcggcggagggaccaagctgaccgtcctaggtcagcccaaggctgccccctccgg

SEQ ID NO: 788099 - DNA, 441 bp, Homo sapiens
  misc_feature: NA.49.79.H02.1.454.light.4.zerom50
agggaaagggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgtctcccgctcactttcggcgggggaccaaggtggagatcaagcgaactgtggctgcamcta

SEQ ID NO: 788100 - DNA, 468 bp, Homo sapiens
  misc_feature: NA.49.79.H02.3.454.light.4.zerom50
agggaaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactctcgttccccg

SEQ ID NO: 788101 - DNA, 450 bp, Homo sapiens
  misc_feature: NA.49.79.H02.4.454.light.4.zerom50
agggaaagggggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggctttgatgtccactggtaccagcagcttccaggaacagcccccaaactcctcatctatggtaacaacaatcggccctcaggggtccctgaccgattctctgcctccaagtctgccacctcggcctccctggccatcactgggctccaggctgaagatgaggctgattattactgccagtcctatgacagcaccatgagtcgttccgtggtcttcggcggagggacccagctgaccgtcctaggtcagcccaagg

SEQ ID NO: 788102 - DNA, 458 bp, Homo sapiens
  misc_feature: NA.5.64.F09.1.454.light.4.zerom50
aggggaggggcagactcagtcaggacacagcatggacatgagggtccccgctcagctcctggggctcctgctgctctggctcccaggtgccaaatgtgacatccaaatgacccagtctcctgccaccctgtctgcttttgtgggagacagaatcaccatcacttgccgggccagtcagactattagtacctggttggcctggtatcagcaaaaaccagggaaagcccctcgtctcctgatctttgatgcctccagtttagaaactggggtcccatcaaggttcagcggccgtggatctgggacagaattcactctcaccgtcaacggcctgcagcctgatgattttgcaacttattactgccatcagtatagtagttttccattcaccttcggccctgggaccaaagtggatctcagtcgaactgtggctgcaccatctgtcttcatcttcccgccta

SEQ ID NO: 788103 - DNA, 452 bp, Homo sapiens
  misc_feature: NA.52.52.E08.1.454.light.4.zerom50
agagagaaaggggtgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacacctacttgaattggtttcagcagaggccaggccaatctccaaggcgcctaatttataaggtttctcaccgggactctggggtcccagacagattcagcggcagtgggtcaggcactgatttcacgctgaaaatcagcagggtggaggctgaagatgttggggtttattactgcatgcaaggcacacactggcctgcgtacacttttggccaggggaccaagctggagaggaaacgaactgtc

SEQ ID NO: 788104 - DNA, 455 bp, Homo sapiens
  misc_feature: NA.52.52.E08.2.454.light.4.zerom50
gycgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaacccactgtcactctcg

SEQ ID NO: 788105 - DNA, 453 bp, Homo sapiens
  misc_feature: NA.51.66.F11.1.454.light.4.zerom50
aaggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtaatgctgtaaactggtaccagcagctcccaggaacggcccccaaactcctcatctacagtagtaatcagcggccctcaggggtccctgaccgattctctggctccaagtctggcacctcagcctccctggccatcagtgggctccagtctgaggatgaggcttattattactgtgcagcatgggatgacagcctgagtgctcatgtggtattcggcggagggaccaagctgaccgtcctaggtcagaccccg

SEQ ID NO: 788106 - DNA, 470 bp, Homo sapiens
  misc_feature: NA.8.1.A01.1.454.light.4.zerom50
aagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactctcgttcccaccctcccg

SEQ ID NO: 788107 - DNA, 439 bp, Homo sapiens
  misc_feature: NA.47.45.E01.1.454.light.4.zerom50
aggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgctagtttattactgtcagcagtatcatgactggccgctcaccttcggccaagggacacgactggagaattaaacgaactgtggctgcaccatcttcg

SEQ ID NO: 788108 - DNA, 456 bp, Homo sapiens
  misc_feature: NA.10.5.A05.1.454.light.4.zerom50
agggggctacaacaggcaggcaggggcagcaagatggtgttgcagacccaggtcttcatttctctgttgctctggatctctggtgcctacggggacatcgtggtgacccagtctccagaatccctggctgtgtctctgggcgagagggccaccatcagctgcaggtccagccagagtgttctcttcaacagaaacaataaggaatgtttagcttggtaccagcagaaaccaggacagtctcctaagctgctcatttactgggcatcgacccgggaatccggggtccctgaccgattcagtggcagcgggtctgggacagaattcactctcaccatcaacagcctgcaggctgaagatgtggcagtttatttctgtcaacagtatctttcttctccgtggacgttcggccaagggaccaaggtggaactcaaacgaactgtggctgcaccatcttcg

SEQ ID NO: 788109 - DNA, 389 bp, Homo sapiens
  misc_feature: NA.3.25.C03.2.454.light.4.zerom50
atccctgagggccggtaattcttaccataaatgacaagtacaggggccttgggacagacagtcaggatcacatgtcaaggagacagcctcagaagctattatgcaagctggtaccagcagaagccaggacaggcccctgtacttgtcatctatggtaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtcactctgttcccaccctcctcgagtgcgtct

SEQ ID NO: 788110 - DNA, 455 bp, Homo sapiens
  misc_feature: NA.10.49.E05.1.454.light.4.zerom50
aacacacaaagggggaggaactgctcagttaggacccagagggaaccatggaagccccagctcagcttctcttcctcctgctactctggctcccagatgccaccggagcagttgtattgacacagtctccagccaccctgtctttgtctccaggggaaagagccaccctctcctgcagggccagtcagagcgttagcaactacttagcctggtaccaacagaaacctggccaggctcccaggctcctcatctatgatgtatccagccgggccactggcgtcccagccaggttcagtggcagtgggtctgggacagacttcactctcaccatcagcagcctagagcctgaagattttgcggtttattactgtcagcagcgtggccactggcctgcgttccctttcggccctgggaccaaagtggatatcaaacgaactgtggctgcaccatctgtt

SEQ ID NO: 788111 - DNA, 442 bp, Homo sapiens
  misc_feature: NA.52.70.G04.3.454.light.4.zerom50
ctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttttgatgtacactggtaccagcagcttccgggaacagcccccaaactcctcatctttggtaacagcaatcggccctccggggtccctgaccgattctctggctccaagtctggcacctcagcctccctggccatcactgggctccaggctgaggatgaggctgattattactgccagtcctatgacagcagcctgagtgtcttttgggtcttcggaactgggaccaaggtcaccgtccg

SEQ ID NO: 788112 - DNA, 456 bp, Homo sapiens
  misc_feature: NA.51.7.A07.1.454.light.4.zerom50
aggggtccaaacagagcttcagcaagcatagtgggaatctgcaccatgccctgggctctgctcctcctgaccctcctcactcactctgcagtgtcagtggtcccggcaggactgacgcagccaccctcggtgtccaagggcttgagacagaccgccacactcacctgcattgggaactactacaatgtgggcgaccaaggaacactttggctgcagcagtaccagggccaccctcccaaactcctgtcctacagggataatacccggccctcagggatctcagagagattctcagcttccacgtcaggatacacagcctccctgaccattactggactccagcctggggacgaggctgactattactgctcagcgtgggacagcagcctcagagcttgggtgttcggcggagggaccaggctgaccgtcctgagtcagcccaaggctcgccccccg

SEQ ID NO: 788113 - DNA, 438 bp, Homo sapiens
  misc_feature: NA.51.31.C09.1.454.light.4.zerom50
agctctgcttcagctgtgagcgcagaaggcaggactcgggacaatcttcatcatgacctgctcccctctcctcctcacccttctcattcactgcacagggtcttgggcccagtctgtgttggcgcagccgccctcagtgtctgcggccccaggacagaaagtcaccatctcctgctctggaaccacctccaacattgggaagaattatgtgtcgtggtaccagcagttcccaggaacggcccccagactcctcattcatgacaataacaaacgagtcccagagatccctgaccgattctctggctccaagtctggcacctcagccaccctggccatcaccggactccagcctggggacgaggccgattattactgcggaacatgggattccagcctgagtggtgtcagggtgttcggcggcgggaccaagctgaccgt

SEQ ID NO: 788114 - DNA, 434 bp, Homo sapiens
  misc_feature: NA.53.32.C10.1.454.light.4.zerom50
ctgggcctcaggaagcagcatcggaggtgcctcagccatggcatggatccctctcttcctcggcgtccttgcttactgcacaggatcggtggcctcctatgagctgagtcagccaccctcagtgtccgtgtccccaggacagacagtccgcatcacctgctctggagataaattgggggataaatttgcttgctggtatcaacagaagacaggccagtcccctgtgttggtcatttatcaagatgacaagcggccctcagggatccctgagcggttctctggctccaactctgggaacacagccactctgaccatcagcgggacccaggctatggatgaggctgactattactgtcaggcgtgggacagcagcactatggtgttcggcggagggaccaagctgaccgtcctaggtcagcccaaggctccgcccg

SEQ ID NO: 788115 - DNA, 447 bp, Homo sapiens
  misc_feature: NA.10.23.C01.1.454.light.4.zerom50
tagggattggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacaccaacaatgtcggcaacgaaggagcagcttggctgcagcagcaccagggccaccctcccaaactcctatcctacaggaataacaaccggccctcagggatctcagagagattctcttcattcaggtcaggaaacacagcctccctgaccattactggactccagcctgaggacgaggctgactattactgctcagcatgggacatcagcctcagtggttgggtgttcggcggagggaccaagctgaccgtcctaggtcacgg

SEQ ID NO: 788116 - DNA, 444 bp, Homo sapiens
  misc_feature: NA.41.24.C02.1.454.light.4.zerom50
tagggaaaggggctgggcctcaggaagcagcatcggaggtgcctcagccatggcatggatccctctcttcctcggcgtccttgcttactgcacaggatctgtggcctcctttgagctgactcagccaccctcagtgtccgtgtccccaggacagacagccagcatcacctgctctggagataaattggggaataaatatgcttcctggtatcagcagaagccaggccagtcccctgtgctggtcatctatcaaagttcccagcggccctcagggatccctgagcgattctctggctccaattctgggaacacagccactctgaccatcagcgggacccaggctatcgatgaggctgagtattactgtcaggcgtgggacatcagcactgaggtggtattcggcggagggaccaagctgaccgtccttggtcagcccaaggcccg

SEQ ID NO: 788117 - DNA, 281 bp, Homo sapiens
  misc_feature: NA.49.44.D11.3.454.light.4.zerom50
agggacagggaccagagccagtccagggagaggacagagccaatggactggggtgtactgtaacagccctgctggtcccaggcagtgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctgttcccaccctcctctctctcgact

SEQ ID NO: 788118 - DNA, 454 bp, Homo sapiens
  misc_feature: NA.13.50.E06.1.454.light.4.zerom50
ctgtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaatatgctcggtggttccagcagaagccaggccaggccccagtactggtgatttataaagacattgagcggccctcagggatccctgagcgattctccggctctaattcagggaccacagtcaccttgaccatcaccggggcccagattgaggatgaggctgactattattgttactctgcggctgacaaccatctggttttcggcgggggaccaagttgaccgtcgtgggtcagcccaaggctcgccccctcggtcactctccgktcccccg

SEQ ID NO: 788119 - DNA, 424 bp, Homo sapiens
  misc_feature: NA.52.32.C10.1.454.light.4.zerom50
agtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccgaaggtggagatcaagcgaactgtggcg

SEQ ID NO: 788120 - DNA, 417 bp, Homo sapiens
  misc_feature: NA.52.32.C10.2.454.light.4.zerom50
agtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctccatacacttttggccaggggaccaagctggagatcagaacg

SEQ ID NO: 788121 - DNA, 461 bp, Homo sapiens
  misc_feature: NA.51.52.E08.2.454.light.4.zerom50
agagwsrrmgggggcttcagctgtgggcacaagaggcagcactcaggacaatctccagcatggccctggtctcctctcctcctcactctcctcgctcactgcacagggtcctgggcccagtctgtrctgacgcagccgccctcagtgtctggggccccagggcagagggtcaccatctcctgcactgggarcagytccaacatcggggcassttatratgtacactggtaccarcaacttccaggarcagcccccaaactcctcatcywtgrtacmcarmaatcggccctcrggggtccctgaccgattctctggctccargtctgrcacytcagcctccctggccatcactgggctccagrctgaggatgaggstgaytattactgccagtcctatgacagcrgsctsastkmtttggtggtkttcggcggmgggaccaagstgaccgtcctaggtcacg

SEQ ID NO: 788122 - DNA, 431 bp, Homo sapiens
  misc_feature: NA.49.26.C04.1.454.light.4.zerom50
agtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatcaagcgaacgwgtggcgtgcacca

SEQ ID NO: 788123 - DNA, 445 bp, Homo sapiens
  misc_feature: NA.49.26.C04.3.454.light.4.zerom50
aaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgttt

SEQ ID NO: 788124 - DNA, 436 bp, Homo sapiens
  misc_feature: NA.49.26.C04.4.454.light.4.zerom50
agctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccvagggtggagatcaaacgtaacg

SEQ ID NO: 788125 - DNA, 442 bp, Homo sapiens
  misc_feature: NA.49.26.C04.6.454.light.4.zerom50
tgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcacgggacccctgagcgattctctggctccagctcagcgacaacagtcacgttgaccatcagtggaggtccgggcagaggacgaggctgactattactgtcagtcatcagacagtagtggcacttctgtcgtattcggcggagggaccaagctgaccgtcctaggtcagcccaaggctcgtccccccg

SEQ ID NO: 788126 - DNA, 437 bp, Homo sapiens
  misc_feature: NA.49.26.C04.8.454.light.4.zerom50
aggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttattactgtcagcagtataattactggtctcgtttttggccgaggggaccaagctggagatcaagcgaactgtggctgcaccatctgtt

SEQ ID NO: 788127 - DNA, 457 bp, Homo sapiens
  misc_feature: NA.40.44.D11.1.454.light.4.zerom50
aagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaacagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccgctcactttcggcggagggaccaaggtggagaccaaacgaactgtggctgcaccatctgtcttcattccckccg

SEQ ID NO: 788128 - DNA, 429 bp, Homo sapiens
  misc_feature: NA.51.72.G06.2.454.light.4.zerom50
agtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttctttagcctggtatcagcaaaaaccagggaaagcccctaagctcctgatctatgctgcatccactttgcaaactggagtcccatcaaggttcagcggcagtggatctgggacagaattcactctcacaatcagcagcctgcagcctgaagattttgcaacttattactgtcaacagcttaatacttaatcctcggacgttcggccaaggaccaaggtaggaaatacaaacgaactagtggctgcaccat

SEQ ID NO: 788129 - DNA, 252 bp, Homo sapiens
  misc_feature: NA.12.25.C03.1.454.light.4.zerom50
aacctatgaacattctgtaggggccactgtcttctccacggtgctcccttcatgcgtgacctggcagctgtagcttccttgaccatcactggggctcaggcggaagatgaggctgactattactgcaactcccgggacagcagtggtaaacatttcaatgtgttattcggcggagggaccaagctgaccgtcctcggtcagcccaaggctgccccctcggtcactctgttcccgccctcctctacgtcgtat

SEQ ID NO: 788130 - DNA, 445 bp, Homo sapiens
  misc_feature: NA.43.32.C10.1.454.light.4.zerom50
agctacaacaggcaggcaggggcagcaagatggtgttgcagacccaggtcttcatttctctgttgctctggatctctggtgcctacggggacttcgtgatgacccagtctccagactccctggctgtgtcgctgggcgacagggccaccatcgactgcaagtccagccagagtgttttatacagctccaacaataagaactacttagcttggtaccagcataaaccaggacagactcctaaactgctcatttactgggcttctacccgggaatccggggtccctgaccgattcagtggcagcgggtctgggacagatttcactctcaccatcagcagcctgcaggctgaagatgtggcagtttattactgtcaacaatattatactattccgtactagttttggccaggggaccaagctggagatcaaacgaactgtggctgcta

SEQ ID NO: 788131 - DNA, 469 bp, Homo sapiens
  misc_feature: NA.43.32.C10.2.454.light.4.zerom50
agctacaacaggcaggcaggggcagcaagatggtgttgcagacccaggtcttcatttctctgttgctctggatctctggtgcctacggggacttcgtgatgacccagtctccagactccctggctgtgtcgctgggcgacagggccaccatcgactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaactaatttcgttaatactccgccgacgttcggcccgggggaccgaccgtggaaacgtacaaacgaactacgtgggckygcaccatctgtccttcta

SEQ ID NO: 788132 - DNA, 483 bp, Homo sapiens
  misc_feature: NA.3.26.C04.1.454.light.4.zerom50
cacgaccggtgctcgatttagtctagcgactttgggtttggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtctccatcacttgccgggccagtcagagtattagtcgctggttggcctggtatcagcagaaaccagggaaagcccctaagctcctgatctatcaggcgtctagtttacaaagtggggtcccatcaaggttcagcggcagtggatctgggacagaattcactctcaccatcagcagcctgcagcctgatgattttgcaacttattactgccaacagtataatacttattggacgttcggccaagggaccaaggtggaaatcaaacgaactagtggctgcaccatctgtcttcta

SEQ ID NO: 788133 - DNA, 452 bp, Homo sapiens
  misc_feature: NA.43.80.H03.1.454.light.4.zerom50
aagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccagggtggagatcaaacgaactagtggctgcaccatctgtctta

SEQ ID NO: 788134 - DNA, 476 bp, Homo sapiens
  misc_feature: NA.43.80.H03.2.454.light.4.zerom50
aaagggaaaggggctgggcctcaggaagcagcatcgggggtgccgcagccatggcctggaccgctctccttctgagcctccttgctcactttacaggttctgtggcctcctatgagctgactcagccactctcagtgtcagtggccctgggacaggcggccaagataacctgtgggggaaacaacattggagataagagtgtccactggtatcaccagaagccaggccaggcccctgtgttggtcatctatagagataccagccggccctctgggatccctgagcgattctctggctccaactcggggaacacggccaccctgaccatcagcagagcccaagccggggatggagggtgactattactgtcaggtgtgggacagcaacactgtgtagttttcggcgggaggggccaagttgaccgtgctaggtcagcccaaggctgccccctcggtcactctcgttcccaccctcct

SEQ ID NO: 788135 - DNA, 454 bp, Homo sapiens
  misc_feature: NA.3.59.F04.1.454.light.4.zerom50
tagggattggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacaccgacttggattggtttcaacagaggccaggccaatctccaaggcgcctaatttataaggtttctaagcgcgactctggggtcccagacagattcagcggcagtgggtcaggcactgacttcacactggaaatcagcagggtggaggctgaggatgttgcggtttattactgcatgcaatatacacataggcctcacacctttggccaggggaccaagctggagatcaaacgaactgtggctgca

SEQ ID NO: 788136 - DNA, 476 bp, Homo sapiens
  misc_feature: NA.9.20.B09.1.454.light.4.zerom50
aggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatcacccccgtgttcggcgggggaccaagctgaccgtcctaggtcagcccaaggctgccccctcggtcactctgttcccaccctcctcagacgtatctacg

SEQ ID NO: 788137 - DNA, 463 bp, Homo sapiens
  misc_feature: NA.12.28.C06.1.454.light.4.zerom50
agtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcggtccacgggaccgacgacgtagaaatagagacgaacgtagtggcgtgcaccactctgtcttctactcttcccgtcccg

SEQ ID NO: 788138 - DNA, 444 bp, Homo sapiens
  misc_feature: NA.3.64.F09.1.454.light.4.zerom50
agggggagtcagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttcggccaggggaccaaggtcgaaatgagacgaactgtggctgcaccatctgtcttcatt

SEQ ID NO: 788139 - DNA, 448 bp, Homo sapiens
  misc_feature: NA.13.72.G06.1.454.light.4.zerom50
ttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctgtt

SEQ ID NO: 788140 - DNA, 448 bp, Homo sapiens
  misc_feature: NA.53.41.D08.2.454.light.4.zerom50
tgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactcgtcactctycg

SEQ ID NO: 788141 - DNA, 448 bp, Homo sapiens
  misc_feature: NA.40.61.F06.2.454.light.4.zerom50
aggaactgctcagttaggacccagagggaaccatggaagccccagctcagcttctcttcctcctgctactctggctcccagataccgccggagaaattgtgttgacacagtctccagccaccctgtctttatctccaggggaaagagccatcctctcctgcagggccagtcagaatattgatacatacttagcctggtaccagcagaaacctggcctggctcccagggtcctcatccatgatgcctcccacagggccactggcatcccacacaggttcagtggcagtgggtctgggacagacttcagtctcaccatcagcagcctagagcctgaggattttgcaatttatttctgtcaacagcgtagcacctggccccgggtcaccttcggccaagggacacgactggacatgaaacgaactgtggctggcaccatctgtctttcatt

SEQ ID NO: 788142 - DNA, 463 bp, Homo sapiens
  misc_feature: NA.4.6.A06.1.454.light.4.zerom50
agggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggattacagcctacatgctcggctgttcggcggagggaccaaactgaccgtcttaggtcagcccaaggctcgtccccccg

SEQ ID NO: 788143 - DNA, 451 bp, Homo sapiens
  misc_feature: NA.43.41.D08.1.454.light.4.zerom50
agctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcaccattccg

SEQ ID NO: 788144 - DNA, 454 bp, Homo sapiens
  misc_feature: NA.43.72.G06.2.454.light.4.zerom50
agagctctggagaagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtactacttttggccaggggaccaagctagaaatacaaacgaactgtggctgcaccatctgtt

SEQ ID NO: 788145 - DNA, 456 bp, Homo sapiens
  misc_feature: NA.43.72.G06.3.454.light.4.zerom50
ctgggcctcaggaagcagcatcgggggtgccgcagccatggcctggaccgctctccttctgagcctccttgctcactttacaggttctgtggcctcctatgagctgactcagccactctcagtgtcagtggccctgggacaggcggccaagataacctgtgggggaaacaacattggagataagagtgtccactggtatcaccagaagccaggccaggcccctgtgttggtcatctatagagataccagccggccctctgggatccctgagcgattctctggctccaactcggggaacacggccaccctgaccatcagcagagcccaagccggggatgagggtgactattactgtcaggtgtgggacagcaacactgtgattttcggcggaggggccaagttgaccgtgctaggtcagcccaaggctgccccctcggtcactctcgttcccrccct

SEQ ID NO: 788146 - DNA, 463 bp, Homo sapiens
  misc_feature: NA.41.49.E05.1.454.light.4.zerom50
aacacacaaagggggaggaactgctcagttaggacccagagggaaccatggaagccccagctcagcttctcttcctcctgctactctggctcccagataccaccggagaaattgtgttgacacagtctccagccaccctgtctctgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagaacctgaagattttgcaatttattactgtcagcagcgtatcaactggcctccgtggacgttcggccgaagggaccaaggtggaaatacaaacgaactagtggctgcaccatctgtttacta

SEQ ID NO: 788147 - DNA, 447 bp, Homo sapiens
  misc_feature: NA.13.81.H04.3.454.light.4.zerom50
tctcaggaggcagcgctctcgggacgtctccaccatggcctgggctctgctattcctcaccctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctccctgaccatctctgggctccaggctgaggatgagtctgattattactgctgctcatatgcaggcagctacamctgtactattcggcggagggaccaagctgaccgtcctaggtcagcccaaggctccgtcccccg

SEQ ID NO: 788148 - DNA, 484 bp, Homo sapiens
  misc_feature: NA.53.65.F10.1.454.light.4.zerom50
agggaggggctgggcctaaggaagcagcactggtggtgcctcagccatggcctggaccgttctcctcctcggcctcctctctcactgcacagactctgtgacctcctatgtgctgactcagccaacctcggtgtcagtggccccaggacagacggccagcattacctgtgggggaaaccacattggagctaaaaatgtgcactggtaccagcagaagccaggccaggcccctgtgctggtcgtctataatggaagcggccggccctcatggatccctgggcgattctctggctccaagtctgggaacacggccaccctaaccatcagcagggtcgaagccggggatgaggccgactattactgtcaggtgtgggataatagtaatggtgggaattgggtgttcggcggagggaccaagctgaccgtcctaggtcagcccaaggctgccccctcggtcactctgttcccgccctcctctcgtacg

SEQ ID NO: 788149 - DNA, 464 bp, Homo sapiens
  misc_feature: NA.41.22.B11.1.454.light.4.zerom50
agggggaagagctgctcagttaggacccagagggaaccatggaaaccccagcgcagcttctcttcctcctgctactctggctcccagatgccaccggagaagttgtgttgacgcagtctccggacactcttgctttgtctccaggacaaagagccaccctctcctgtacggccagtgagagtatttccagcaccttcttagcgtggtaccagcagaaacctggccaggctcccaggctcctcatctcaggtacatatgccagggccgctggcatccctgacaggttcagtggcagtgggtctgcgacagacttcactctcaccatcagtagactggagcctgaagattttgcaacatattactgtcaccagtatgcaatctcacccaggacgttcggccgaagggaccgagggtggaaagtacaagcgaactgtggctgcaccatctgtcttctatcttccccg

SEQ ID NO: 788150 - DNA, 416 bp, Homo sapiens
  misc_feature: NA.41.22.B11.3.454.light.4.zerom50
agggcacgaccggtgctcgatttagacgacagctcagggcacgaccggtgctcgatttagwctagcgatckwwgggtttggggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatacaaacgaactgtggctgcaccatctgtcttcatccttcccgccatctgaatagtataga

SEQ ID NO: 788151 - DNA, 451 bp, Homo sapiens
  misc_feature: NA.12.57.F02.1.454.light.4.zerom50
ttgggtttggggagagctctggggagtctgcaccatggcttggaccccactcctcttcctcaccctcctcctccactgcacagggtctctctcccaacttgtggtgactcaatcgccctctgcctctgcctctctgggagcctcggtcaagctcacctgcactctgagcagtgggcacactaccttcgccatcgcctggcatcaacaacagccagagaggggccctcgatacttgatgattgttaacagtgatggcagccacaacaagggggacgggatccctgatcgcttctcaggctccagttctggggctgagcgctacctcaccatctccagcctccagtctgaggatgaggctgactattactgtcagacctggggcactggcattgtggtattcggcggagggacgaagctgaccgtcctgggtcagcccaaggctgccccctcc

SEQ ID NO: 788152 - DNA, 461 bp, Homo sapiens
  misc_feature: NA.40.63.F08.1.454.light.4.zerom50
agggggcaggagtcagtctcagtcaggacacagcatggacatgagggtccccgctcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagttggtatcagcagaaaccagggaaagcccctagactcctgatctatactgcgtccactttgcaaggtggggtcccccaaggttcagtggcagtggatctgagacagatttcagtcttactatcagcaatctgcaacctgaagattttgcgacttactactgcctacagacttacgacttcccgtggacgttcggccaagggaccaaggtggaaatcaaacgaactgtggctgcaccatctgtcttcatcttccccgccta

SEQ ID NO: 788153 - DNA, 421 bp, Homo sapiens
  misc_feature: NA.15.81.H04.2.454.light.4.zerom50
tctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctcctcgctacgtaga

SEQ ID NO: 788154 - DNA, 444 bp, Homo sapiens
  misc_feature: NA.52.10.A10.2.454.light.4.zerom50
agggrgsrggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcaccatctgtctt

SEQ ID NO: 788155 - DNA, 474 bp, Homo sapiens
  misc_feature: NA.19.81.H04.1.454.light.4.zerom50
ctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaagcccccaagacactgatttctgatacaaccaacagacattccttgacacccgcccgcttttcaggttacctccttgggggcaaagctgccctgaccctttcgggcgcgcagcctgaggatgaggcagagtacctgtgttccctcgtccactccggtttttttgtgttcggcggagggaccagactgaccgtcctcggtcagcccaaggctgccccctcggtcactctgttcccgccctcctccacgagagta

SEQ ID NO: 788156 - DNA, 457 bp, Homo sapiens
  misc_feature: NA.53.6.A06.2.454.light.4.zerom50
agggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggcccctctattggtaatgtataaagacaatgagaggccctcagggatccctgagcgattctctggctccaactcagggacaacagtcacgttgaccatcggtggagtccaggcagaagacgaggctgactattactgtcaatcagcaggcagcagtggaactgtgcttttcgggcggagggaccaagctgaccgtcctacgtcagcccaaggctcgccccctcggtcacttccg

SEQ ID NO: 788157 - DNA, 452 bp, Homo sapiens
  misc_feature: NA.47.30.C08.1.454.light.4.zerom50
aagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggcctaggggaccaaacgtcggacatcaaacgaactgtggctgcaccatcctgtt

SEQ ID NO: 788158 - DNA, 448 bp, Homo sapiens
  misc_feature: NA.13.36.D03.2.454.light.4.zerom50
atctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacgactggagattaaaggaactgt

SEQ ID NO: 788159 - DNA, 452 bp, Homo sapiens
  misc_feature: NA.21.47.E03.1.454.light.4.zerom50
agagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaactggttagcctggtatcagcagaaaccaggaaaagcccctaaactcctgatctatgctgcatccacgttgcaaagtggagtcccgtcaaggttcagcggcagtgggtctgggacggatttcaatctcaccatcaccagcctgcagcctgaagattttgcaacttattattgtcaacaggctaacagttttcctctcacgttcggcggagggaccaacgtggaggtcaaacgaactgtggctgcaccatctgtt

SEQ ID NO: 788160 - DNA, 434 bp, Homo sapiens
  misc_feature: NA.15.75.G09.1.454.light.4.zerom50
agggggggcgagagcgaggctacggagcaggcgagaggcgacggcgagagctagagcgggcgcagcgttagggtggccgtgcaaggggagccgtggcccgggcccggggcgtgcgagacggcggaagcagcccagggccttgctgccgccatgactgaggaatcagaggagacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcacca

SEQ ID NO: 788161 - DNA, 441 bp, Homo sapiens
  misc_feature: NA.3.28.C06.2.454.light.4.zerom50
aggaactgctcagttaggacccagagggaaccatggaagccccagctcagcttctcttcctcctgctactctggctcccagatattaccggagaaattgtgttgacacagtctccagtcaccctgtctctggctccaggggaaagagccaccctctcctgtagggccagtcagagtgttgccactcacttagcctggtaccagcagaaacctggccaggctcccagactcctcatctatgatgcatccaacggggccactggcatcgcagccaggttcagtggcagtgggtctgggacagacttcactctctccatcaggaatctggagcctgaagattctgcaatttatttctgtcagcagcgtagcagctggcctcccactttcggcggagggaccaaggtggaggatcaaacgaactagtggctgcaccatctgtctt

SEQ ID NO: 788162 - DNA, 493 bp, Homo sapiens
  misc_feature: NA.52.64.F09.1.454.light.4.zerom50
aggggctgggcctaaggaagcagtactggtggtgcctcagccatggcctggaccgttctcctcctcggcctcctctctcactgcacagtctctgtgacctcctatgtgttgactcagccgccctcggtgtcagtggccccaggaaagacggccagtcttatttgtgggggagacaacattggaagtagaagtgtacactggtaccagaagaagtcaggccgggcccctgtcctggtcgtctctgaggatagcgaccggccctcagggatccctgagcgattctctggatccaactctggaggaaacacggccaccctgaccatcagcagagtcgaagccggggatgaggccgactattattgtcagggtgtgggattttaggaagtgatcagtccggggggtgttcgggcggtgggaccaggttgaccggtccgtaggtcagcccaaggctgccccctcggtcactctgttcccrccctcctctatacgatcg

SEQ ID NO: 788163 - DNA, 445 bp, Homo sapiens
  misc_feature: NA.3.56.F01.1.454.light.4.zerom50
aacacacaaagggggcaggagtcagtcccaaccaggacacagcatggacatgagggtccctgcccagctcctggggctcctgctgctctggctctcaggtgccagatgtgacatccagatgacccagtctccaccctccctgtctgcttctgtaggagatagagtcatcatcacttgccaggcgagtcaagacattagtgacaatttaaattggtatcaccagaaaccaggggaagcccctaagctcctgatctacgatgcatccagtttgcaaacaggggtcccatcaaggttcagtggacgtggatctgggacagatttcacttgcaccatcagcggcctgcagcctgaagatgttggaacatattactgtcaacagtatgatcagctcctttctttcggccctgggaccaaagtggaaatcaggcgaactgtggctgcacca

SEQ ID NO: 788164 - DNA, 479 bp, Homo sapiens
  misc_feature: NA.52.21.B10.1.454.light.4.zerom50
agagagggggaaaaggccctgaggagaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctcctaatttctaccccagctggtaccagcagaccccaggccaggctccacgcacgctcatctacagcacaattactcgctcttctggggtccctgatcgcttctctggctccatccttgggaacaaagctgccctaaccatcacgggggcccaggcagatgatgaatctgattattactgtgtcctctatatgggtagtggcatttggatgttcggcggagggaccaackgaccgtcctgggtcagcccaac

SEQ ID NO: 788165 - DNA, 463 bp, Homo sapiens
  misc_feature: NA.51.72.G06.4.454.light.4.zerom50
tctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcagtcggtgtgctattcggcggagggaccaagctgaccgtcctaggtcagcccaaggcctcgccccctcggtcactctgttccct

SEQ ID NO: 788166 - DNA, 443 bp, Homo sapiens
  misc_feature: NA.41.60.F05.1.454.light.4.zerom50
gggaaagggggatcaggactcctcagttcaccttctcacaatgaggctccctgctcagctcctggggctgctaatgctctgggtctctggatccagtggggatattgtgatgactcagtctccactctccctgtccgtcagccctggagagccggcctccatctcctgcaggtctagtcagagcctcctgtattctaatggatacagtaatttgaattggtacgtgcggaagccagggcagtctccacagctcctgatatattgggcttctcatcgggcctccggggtccctgacaggttcagtggcagtgggtcaggcacagattttactctgcacatcagcagagtggaggctgaggatgctgcgacttattactgcatgcaacctctacaaactgtgtggacgttcggccaggggaccagggtggaaatcaagcgaactt

SEQ ID NO: 788167 - DNA, 445 bp, Homo sapiens
  misc_feature: NA.46.13.B02.1.454.light.4.zerom50
ttvggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaacg

SEQ ID NO: 788168 - DNA, 441 bp, Homo sapiens
  misc_feature: NA.3.20.B09.1.454.light.4.zerom50
agggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccaaggtggagatcaaacgaactagtggctgcaccta

SEQ ID NO: 788169 - DNA, 434 bp, Homo sapiens
  misc_feature: NA.47.25.C03.1.454.light.4.zerom50
aacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccasccctcctctacgtgagct

SEQ ID NO: 788170 - DNA, 453 bp, Homo sapiens
  misc_feature: NA.40.26.C04.2.454.light.4.zerom50
aagagctgctcagttaggacccagagggaaccatggaarccccagcscagcttctcttcctcctgctactctggctcccagmwgccmccggagaarttgtsytgacrcagtctccagmcaccctgtcyttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgccat

SEQ ID NO: 788171 - DNA, 451 bp, Homo sapiens
  misc_feature: NA.51.22.B11.1.454.light.4.zerom50
aggggtcagctgcgggtagagaagacaggactcaggacaatctccagcatggcctggtcccctctcttcctcaccctcatcactcactgtgcagggtcctgggcccagtctgtgctgactcaaccaccctcggtgtctgaagcccccaggcagagggtcaccatctcctgttctggaagcaactccaacatcggaaataatggtgtaaactggtaccagcaactcccaggaaaggctcccaaactcctcatctattatgatgatctgctgccctcaggggtctctgaccgattctctggctccaagtctggcacctcagcctccctggccatcagtggcctccagtctgaggatgagggtgattattactgtgcagcatgggatgacagcctgaagtggggccctgttcggcggagggaccaagctgaccgtcctaagtcagcccaaggcc

SEQ ID NO: 788172 - DNA, 461 bp, Homo sapiens
  misc_feature: NA.51.22.B11.2.454.light.4.zerom50
aggggactgcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattcggcggggggaccaaacgtgaccgtcctaggtcagcccaaggctgccccycggt

SEQ ID NO: 788173 - DNA, 458 bp, Homo sapiens
  misc_feature: NA.40.26.C04.1.454.light.4.zerom50
agaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccgcat

SEQ ID NO: 788174 - DNA, 437 bp, Homo sapiens
  misc_feature: NA.51.82.H05.2.454.light.4.zerom50
cacgaccggtgctcgatttagtcgagctctcagagagaaagggggtaggctcaggaggcagagctctgattgtctcaccatggcctggatccctctcctgcctccccctcctcattctctgcacagtctctgtggcctcctatgagctgacacagccatactcagtgtcagtgtctccgggacagacagccaggatcacctgctcaggagatgtactagggaaaaaatatgctcgttggttccagcagaaggcgggccaggcccctgtcttgatgatttataaagacactgagyggccctcgagggatccctgagcgattctccggctccagctcagggactacagtcaccttgaccatcaggccggggcccaggttgacgatgaggctggactattacttgttactctgcggctgacaacwawtctgggataktcc

SEQ ID NO: 788175 - DNA, 443 bp, Homo sapiens
  misc_feature: NA.5.7.A07.1.454.light.4.zerom50
agggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagaccgagtcaccatcacttgccgggcaagtcagaacattaccacctatttacattggtatctgcagaagccagggagagcccctaagctcctgatctatgcttcatccaatttgcacagtggggtcccgtcaaggttcagtggcggtggctctgagacagatttcactctcaccatcagcagtctgcaacctgaagattttgcaacttactactgtcaacagagttaccggtacccccctcacctttcggcggagggaccgaaggttgagatcaaacgaactgtggctgcaccta

SEQ ID NO: 788176 - DNA, 408 bp, Homo sapiens; identical to SEQ ID NO: 787559
  misc_feature: NA.53.70.G04.1.454.light.4.zerom50

SEQ ID NO: 788177 - DNA, 469 bp, Homo sapiens
  misc_feature: NA.51.49.E05.2.454.light.4.zerom50
aacacacaagggggtgggctcagaagcagagttctggggtgtctccaccatggcctggacccctctctggctcactctcctcactctttgcataggttctgtggtttcctctgagctgactcaggaccccgctgtatctgtggccttgggacagacagtcaggatcacatgccaaggagacagcctcacaagttattatgcaggctggtaccagcagaagccaggacaagcccctatacttgtcctctatggtaataatcaccggccctcagggatcccagaccgattctctggctccagctcaggaaacacagcttccttgaccatcactggggctcaggcggaagatgaggctgactactactgtaattcccgggacaccagtggtcatagtggaaaccgggtcgtgttcggcggagggaccaaggtgaccgtcctgggtcagcccaaggctgccccctcggtctac

SEQ ID NO: 788178 - DNA, 480 bp, Homo sapiens
  misc_feature: NA.52.74.G08.1.454.light.4.zerom50
aggaggggctgggcctcaggaagcagcatcgggggtgccgcagccatggcctggaccgctctccttctgagcctccttgttcactttacaggttgtctggcctcctatgaactgactcagcctctctcagtgtcagtggccctgggacagacggccacaattacctgcgggggagacaatattgtgaccagacatgtgcactggtatcagcagaagccaggccaggcccctgtcctggtcatctatagggatattaagcggccctctggaatccctgagcgattcactggcgccaattcggcaaacacggccaccctgaccatcagtgaagcccaagtcggggatgaggctgactactcgtgtcaggtggtgggacagcggcactatgattttcggcggagggaccaagttgaccgtcctaagtcagcccaaggctcgccccctcggtcactctcgttcccgccctyctctatacgatcg

SEQ ID NO: 788179 - DNA, 450 bp, Homo sapiens
  misc_feature: NA.52.26.C04.3.454.light.4.zerom50
ctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctcgccccctcggtcactc

SEQ ID NO: 788180 - DNA, 458 bp, Homo sapiens
  misc_feature: NA.52.26.C04.1.454.light.4.zerom50
tctagcgactttgggtttgggsctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtcccctgtcctggtcatctatcaagatgtcaagcggccctcagggatccctgagcgattctctggctccaactctgggaacacagccactctgaccatcagcgggacccaggctatggatgaggctgactattactgtcaggcgtgggacagcaacactgtggtattcggcggagggaccaagctgaccgtcctaggtcagcccaaggtccgccccccg

SEQ ID NO: 788181 - DNA, 458 bp, Homo sapiens
  misc_feature: NA.52.26.C04.2.454.light.4.zerom50
tgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcasgcccaaggccaaccccactgtcactcttcccggtcccccg

SEQ ID NO: 788182 - DNA, 436 bp, Homo sapiens
  misc_feature: NA.52.26.C04.4.454.light.4.zerom50
cagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaacaccttaatagttactccttctactttcggccctgggaccaaagtaggacatcaaacgaactgtggctgcaccatctgtctt

SEQ ID NO: 788183 - DNA, 426 bp, Homo sapiens
  misc_feature: NA.52.26.C04.5.454.light.4.zerom50
cctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtcccctgtcctggtcatctatcaagatgtcaagcggccctcagggatccctgagcgattctagcgggacccaggctatggatgaggctgactattactgtcaggcgtgggacagcaacactgtggtattcggcggagggaccaagctgaccgtcctaggtcagcccaaggctgccccctcggtcactctgttcccrccctcctctatacgatcg

SEQ ID NO: 788184 - DNA, 459 bp, Homo sapiens
  misc_feature: NA.48.44.D11.1.454.light.4.zerom50
agggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcaccatacttcg

SEQ ID NO: 788185 - DNA, 493 bp, Homo sapiens
  misc_feature: NA.52.79.H02.2.454.light.4.zerom50
  modified_base (480)..(480): a, c, t, g, unknown or other
agggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccrgmaatgacattggtrsttataattmtgtctcctggtaccaacamyacccmggcaaagyccccaaactcatkatytwtgrkgtcrgtgaycggccckcaggggtttctmatcrcttctcyggctccaagtcyggcarcacggcctccctgaccatctctgggctccaggcygaggacgaggctgattattactgcrsctcatatacaaacarmaacamttgggtgttcggcggmgggaccaarctgaccgtcctacsgtcagcccaaggctgccccctcggtcactctcgttcccncctcctctatacg

SEQ ID NO: 788186 - DNA, 487 bp, Homo sapiens
  misc_feature: NA.48.44.D11.2.454.light.4.zerom50
agggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggkcggagggaccaagctgaccgtcctaggtcavcccaaggccgtcccchcgrycgaggccgtcccgtccccgtccg

SEQ ID NO: 788187 - DNA, 442 bp, Homo sapiens
  misc_feature: NA.48.44.D11.3.454.light.4.zerom50
agggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaaggtccg

SEQ ID NO: 788188 - DNA, 473 bp, Homo sapiens
  misc_feature: NA.48.44.D11.4.454.light.4.zerom50
agggtttggggccaaaggatgggagrgggtywggctggrastsaggascmrstsrggrcacwkcwysswctawsaskstccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggtccaagggaccgaacggtggaagtcaaacgaactagtggctgcacc

SEQ ID NO: 788189 - DNA, 446 bp, Homo sapiens
  misc_feature: NA.43.45.E01.2.454.light.4.zerom50
agtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgctaacttattactgtctacaagattcttcttaccctcggacgttcggtccgacgggaccgacggtcggagtgtccaagacgaacgtmgtggcgtgcaccatcttcg

SEQ ID NO: 788190 - DNA, 446 bp, Homo sapiens
  misc_feature: NA.11.84.H07.1.454.light.4.zerom50
agtggagaccaccacaccctccaaacaaagcaacaacaagtacgcggccagcagctacctgagcctgacgcctgagcagtggaagtcccacaaaagctacagctgccaggtcacgcatgaagggagcaccatggcctggactcctctctttctgttcctcctcacttgctgcccagggtcccattctcagactgtggtgactcaggagccctcactgactgtgtccccaggaggcacagtcactctcacctgtgcttccagcactggagcagtcaccaatggattccatccaaactggttccagcagaaaccctggacaaccacccagggcactcatttatagtacaaaacaacagacactcctggacccctgaccggttctcaggctccctccttggggscagagctgccctgacacctgtcagggtgtgcagcctgacggacgg

SEQ ID NO: 788191 - DNA, 464 bp, Homo sapiens
  misc_feature: NA.53.10.A10.1.454.light.4.zerom50
aaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatgggacagcgaaattgcggtgttcggcgggggaccaaactgaccgtcctaggtcagcccaaggctgccccctcggtcactctgttccccgcccttcc

SEQ ID NO: 788192 - DNA, 461 bp, Homo sapiens
  misc_feature: NA.40.28.C06.1.454.light.4.zerom50
agagaagagcttctcagttaggacccagagggaaccatggaaaccccagcgcagcttctcttcctcctgctactctggctcccagatgccaccggagaaattgtgttgacgcagtctccaggtaccctgtctttgtctccaggggaaagagccaccctctcctgcagggccagtcagagtattaggaacactgtccaaggctggtatcagcataaacctggccaggctcccaggctcctcatctatgagacgtccaggagggccagtggcatcccagacaggttcagtggcagtgggtctgggaccgacttcactctaaccatcagtagactggaacctgaagactctgcagtgtattactgtcaacactttgaaggcccacttatcacattcggcggagggaccaaggtggagatcaagcgaactgtggctgcaccatctgtcttcatcttcccgtccca

SEQ ID NO: 788193 - DNA, 449 bp, Homo sapiens
  misc_feature: NA.40.28.C06.2.454.light.4.zerom50
ctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaaggcctccg

SEQ ID NO: 788194 - DNA, 437 bp, Homo sapiens
  misc_feature: NA.12.49.E05.1.454.light.4.zerom50
aacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtacaaaagtataacagtcgcccccttcacccttcggccaagggacacgactggagattagaacgg

SEQ ID NO: 788195 - DNA, 476 bp, Homo sapiens
  misc_feature: NA.47.86.H09.1.454.light.4.zerom50
ttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatattttgtcaggtgtgggagactaattttggtcatatgttgttcggcggagggaccaagctgaccgtcctcggtcagcccaaggctgccccctcggtcactctgttcccaccctcctc

SEQ ID NO: 788196 - DNA, 443 bp, Homo sapiens
  misc_feature: NA.10.3.A03.1.454.light.4.zerom50
agcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggcctggtatcagaagaaaccagggaaagccccgaaactcctgatccatactgcctccactttggcaagtggggtcccatcaaggttcagcggcagtggagctgggacagagttcactctcagtatcagcagcctgcagcctgatgattttgcaacctattattgtcaacaatatgacacttatccattctctttcggccctgggaccaaagtggattccaaacgaactgtggctgcaccatctgtcttcatcttcccgccatctgacactactac

SEQ ID NO: 788197 - DNA, 448 bp, Homo sapiens
  misc_feature: NA.49.1.A01.2.454.light.4.zerom50
aggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatttcctgcactgggagcagctccaacatcggggcaggttatgatgtacactggtatcagcagcttccaggaacacgcccccaaactcctcatctatagtaacaaaaatcggccctcaggggtccctgaccgattctctggctccaagtctgacacctcagcctccctggccatcactgggctccaggctgaggatggaggcggagtattactgccagtcctatgacagcagcctgagtggtcttgtcttcggaactgggaccaaggtcaccgtcctgggt

SEQ ID NO: 788198 - DNA, 440 bp, Homo sapiens
  misc_feature: NA.4.7.A07.1.454.light.4.zerom50
agggggaaaaggccctgaggaaaacaaaccccagctgggaagcctgagaacacttagccttcatgagtgtccccaccatggcctggatgatgcttctcctcggactccttgcttatggatcaggagtgaattctcagactgtggtgacccaggagccatcgttctcagtgtcccctggagggacagtcacactcacttgtgacttgagctctggctcagtctctactagttactgccccagctggtaccagcagaccccaggcctgactccacgcacgctcatctacagcacaagcgctcgctcttctggggtccctgatcgcttctctggctccatccttgggaacaaagctgccctcaccatcacgggggcccaggcagatggtcagcccaaggctgccccctcggtcactctgttcccaccctcctcctacagtgct

SEQ ID NO: 788199 - DNA, 455 bp, Homo sapiens
  misc_feature: NA.5.49.E05.1.454.light.4.zerom50
aacacacaaagggggctgctcagttaggacccagagggaaccatggaaaccccagcgcagcttctcttcctcctgctactctggctcccagataccgtcggagaagtcgtgttgacgcagtctccagacaccctgtctttgtctccaggggagagagccaccctctcctgcagggccagtgagagtcttggcggcagtcacttagcctggtaccagcaaaaacctggccaggctccccggctcctcatctatggtgcgtccaacagggccactgacaccccacgcagattcagcggcagtgggtctgggacagacttcactctcaccatcctcagagtggagcctgaagattttgcagtatattactgtcagcagtatggcttctcacctcacaatttcggcggcgggaccaaggtggagaccaaacgaactgtggctgcaccatctgtcttcta

SEQ ID NO: 788200 - DNA, 462 bp, Homo sapiens; identical to SEQ ID NO: 787616
  misc_feature: NA.48.76.G10.2.454.light.4.zerom50

SEQ ID NO: 788201 - DNA, 449 bp, Homo sapiens
  misc_feature: NA.5.49.E05.2.454.light.4.zerom50
aacacacaaagggggctgctcagttaggacccagagggaaccatggaaaccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtctt

SEQ ID NO: 788202 - DNA, 443 bp, Homo sapiens
  misc_feature: NA.7.83.H06.1.454.light.4.zerom50
tcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagcctccctgaccattactggactccagcctgaggacgaggctgactattactgctcagcatgggacagcagcctccgtggtgtggtgatcggcggagggaccaggctgaccgtcctaggtaccg

SEQ ID NO: 788203 - DNA, 447 bp, Homo sapiens
  misc_feature: NA.52.73.G07.1.454.light.4.zerom50
aggggtgatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaaatcagcagagtggaggctgaggatgttggggtttattactgcatgcaagttctacaaaatcctcgcacttttggccaggggaccaagctggagatcaaacgaactgtggygtcg

SEQ ID NO: 788204 - DNA, 460 bp, Homo sapiens
  misc_feature: NA.5.20.B09.1.454.light.4.zerom50
agggggagctacaacaggcaggcaggggcagcaagatggtgttgcagacccaggtcttcatttctctgttgctctggatctctggtgcctgcgggggcatcgtgatgacccagtctccagactccctggctgtgtctctgggcgagagggccgccatcaactgcaagtccagccagaatattttatacagttccaataataagaactacttagcttggtaccaacagaaaccaggacagcctcctaagctgctcatttcctgggcgtctacccgggaatccggggtccctgaccgattcactggcagcgggtctgggacagatttcactctcaccatcgacagcctgcaggctgaggatgtggcagtttattactgtcagcaacattatagttcgtggacgttcggccaggggaccgaaggtggaaatacaaacgaactgtggctgcaccatctgtcttt

SEQ ID NO: 788205 - DNA, 457 bp, Homo sapiens
  misc_feature: NA.48.49.E05.2.454.light.4.zerom50
aacacacaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggcggagggaccgaaggtggagatacaaacgaactgtggctgcaccatctgtt

SEQ ID NO: 788206 - DNA, 386 bp, Homo sapiens
  misc_feature: NA.40.7.A07.1.454.light.4.zerom50
agggggagaaattgtgttgacgcagtctccaggcaccctgtctttgtctccaggggaaagagccaccctctcctgcagggccagtcagagtgtcagcagcggctacttaggctggtaccagcagaaacctggccaggctcccaggctcctcatctatggtgcatccagcagggccactggcatcccagacaggttcagtggcagtgggtctgggacagacttcattctcaccatcagcggactggagcctgaagattttgcagtgtattactgtcagcagtatggtaactcatcgtacacttttggccaggggaccaagctggagatcaaaacgaactgtggctgcaccatctgtcttcatcttcccgccatctgaagtcgctaga

SEQ ID NO: 788207 - DNA, 399 bp, Homo sapiens
  misc_feature: NA.17.11.A11.1.454.light.4.zerom50
agggagagtggagactgagtcatcacaacatctccactctccctgcccgtcactcttggacagccggcctccatctcctgcaggtctagtgaaagcctcgtagacagtgatggaaacacctacttgaattggtttcaacagaggccaggccaatctccaaggcgcctaatttataaggtttctaaccgggactctggggtcccagacagattcagcggcagtgggtcaggcactgatttcacactgagaatcagcagggtggaggctgaggatgttggggtttattactgcttgcaaggtacacactggtacacttttggccaggggaccaagctggagatcaaacgaactgtggctgcaccatctgtcttcatcttcccgccatctgactagtctacg

SEQ ID NO: 788208 - DNA, 465 bp, Homo sapiens
  misc_feature: NA.4.11.A11.2.454.light.4.zerom50
aggggcagcaagatggtgttgcagacccaggtcttcatttctctgttgctctggatctctggtgccctcggggacatcgtgatgacccagtctccagactccctggctgtgtctctgggcgggtkggccaccatacgaactgactaagtccagccagagtcttttatacgggtccgacggtaagaattatttagcttggtatcagcaaaagccaggacagcctcctaagttgctcatttactgggcgactttccgtgattacggggtccctctccggttcagtggcggcgggtctgggacagacttcactctcaccatcgacagcctgcaggatgaagatgtggcagtctatttctgtcagcaatattatactactcccccggacattcggccaagggaccaaggtggagatcaagcgaactgtggctgcaccatctgtcttcatcttcccgccatctgactacg

SEQ ID NO: 788209 - DNA, 397 bp, Homo sapiens
  misc_feature: NA.17.11.A11.2.454.light.4.zerom50
ggggtctctgcatctagtagggccgatctctgcgctcctgacggtgctcgcctttatccatttttccaggtcctccacgtcctcctcttcttcctcccatctgttccatcaaaggtccaggggggccccccagggccacctcgtcttcctccaccaaagccacctcggtccatgccccggccaccacggaagccacctctgtctccaccacggccacctctgaacattccaccgggaccaccacgatccatgaggccacctcttcctccccgcatgccaccagggccacctctgccacgatcaccacccgggggcggaaagggtggcgggaggaagccttcaggctttggggccttacactggttgcactctgttcccaccctcctcctagtctacg

SEQ ID NO: 788210 - DNA, 459 bp, Homo sapiens
  misc_feature: NA.3.23.C01.1.454.light.4.zerom50
tagggattggggggagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagagacctggccaggctcccaggctcctcatccatggtgcatccaacagggccactggcatcccagacaggttcagtggcagtgggtctggaacagacttcactctcaccatcagcagactggagcctgaagactttgcagtttattactgtctgcagtatggtacttcactcttggtcaatttcggcggcgggaccaaggtggagatcaaacgaactgtggctgcaccatctgtcttcta

SEQ ID NO: 788211 - DNA, 454 bp, Homo sapiens
  misc_feature: NA.43.28.C06.1.454.light.4.zerom50
tgactgatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtactggaggcacctacttgagttggtttcaccagaggccaggccaatctccaaggcgtctgatttataagatttctatccgggactctggggtcccagacaggttcagcggcagtgggtcagacactgacttcacactgagaatcagcagggtggaggctgaggatgttggaatttattactgcatgcaatcttcacactggcctccgtacacttttggccaggggaccaagctggagatcaaacgaactgtggctgcacctat

SEQ ID NO: 788212 - DNA, 455 bp, Homo sapiens
  misc_feature: NA.43.28.C06.2.454.light.4.zerom50
agctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaaatacaaacgaactgtggctgcaccatctgtctt

SEQ ID NO: 788213 - DNA, 445 bp, Homo sapiens
  misc_feature: NA.43.28.C06.3.454.light.4.zerom50
tcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacactttatgtcttcggaattgggacgacggtcaccgtcctaggtcagcccaaggcccaacccya

SEQ ID NO: 788214 - DNA, 441 bp, Homo sapiens
  misc_feature: NA.10.73.G07.1.454.light.4.zerom50
agggggagtcagtctcagtcaggacacagcatggacatgagggtccccgctcagctcctggggctcctgctactctggctccgaggtgccagatgtgacatccaaatgacccagtctccatcctccctgtctgcatctttaggcgacagagtcaccattacttgccgggcaagtcagagcattaccaactctttaaattggtttcaacagaggccagggaaagcccctaagctcctggtctatggtgcatccactgtgcaaactggggtcccatccaggttcagtggcagtggatttgggacagatttcactctcaccatcaacaatctgcagcctgatgatttcgcaacttactactgtcaacagagttacacgacgccaatcactttcggccctgggaccaaagtggatatcaagcgaactgtggctgcaccatctgtt

SEQ ID NO: 788215 - DNA, 426 bp, Homo sapiens
  misc_feature: NA.21.76.G10.1.454.light.4.zerom50
aagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggcgggtcaggacattagacattatttagcctggtatcagcagaaaccaggtaaagttcccaagctcctgatctatgctgcatcctctttgcaatcaggggtcccatctcggttcagtggcagtggatctgggacagatttcactctcaccatcagcagcctgcagcctgaagatgttgcaacttattactgtacaaaaatatagcagtgcccctctcactttcggcgcagggaccaaggtggacatcaaaacg

SEQ ID NO: 788216 - DNA, 485 bp, Homo sapiens
  misc_feature: NA.51.82.H05.1.454.light.4.zerom50
cacgaccggtgctcgatttagtcgagctctctcgcggggctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttccaggaacagcccccaaactcctcatccatgataccagaaatcggccctcgggggtccctgaccgattctctggctccaagtctgacacttcagcctccctggccatcactgggctccagactgaggatgaggctgactattactgccagtcctatgacagcaggctgactgctgtggttttcggcggcgggaccaagctgaccgtcctaggtcacgg

SEQ ID NO: 788217 - DNA, 454 bp, Homo sapiens
  misc_feature: NA.15.74.G08.1.454.light.4.zerom50
agggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaagcccctaaactcctgatgtataaggcatctagcttagaaagtggggtgccatcaaggttcagcggcagtggatctgggacagaattcactctcaccatcagcaccctgcagcctgatgattttgcaacttattactgtcaacagtataatagtaattcctggacgttcggccaagggaccgaaggtaggaaatacaaacgaactagtggctgcaccatctgtcttata

SEQ ID NO: 788218 - DNA, 465 bp, Homo sapiens
  misc_feature: NA.52.84.H07.1.454.light.4.zerom50
agtcagtcccaaccaggacacagcatggacatgagggtccctgctcagctcctggggctcctgctgctctggctctcaggtgccagatgtgacatccagatgacccrgkskcmmtyctccctstcwrcatctstmssmkrywgarkcaycttcayktgmcgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcggcggagggaccaaggtacgagatcaaacgaactgtggctgcaccatctgtcttcatcttcccgcatctgatatacgatcg

SEQ ID NO: 788219 - DNA, 441 bp, Homo sapiens
  misc_feature: NA.52.50.E06.1.454.light.4.zerom50
tgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtgatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctcgccccctccg

SEQ ID NO: 788220 - DNA, 339 bp, Homo sapiens
  misc_feature: NA.12.14.B03.1.454.light.4.zerom50
ttgagtttgggggccgttcctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccaccctcctctacgtcgtat

SEQ ID NO: 788221 - DNA, 449 bp, Homo sapiens
  misc_feature: NA.8.74.G08.1.454.light.4.zerom50
aaggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcacctgcactggatccagcggagacattgggagttatgatgttgtctcttggtatcagcatcacccaggcacagccaccaaattcataatttatcaggtcacgcagcggcccttaggggtttctgatcgcttctctggctccaagtctggcaacacggcctccctgacaatctctgggctccagcctgaggacgaggctgattattactgctgctcatatggtggttctaacactccctatgtcttcggaggtgggaccaaggtcaccgtcctgcgtcagcccaacsga

SEQ ID NO: 788222 - DNA, 397 bp, Homo sapiens
  misc_feature: NA.14.61.F06.1.454.light.4.zerom50
cttcagggacctctgggctgatccttggtctcctgctcctcaggctcaccggggcccaacactgactcactggcatgtgtttctccctctttccagggtcctgggcccagtctgccctgactcaacctgcctccatgtctgggtctcctggacagtcgatcaccatctcctgcactggatccagcagtgacattggtgattataagtgtgtctcctgataataccgacacccaggcaaagtccccaaagtcatgatttctggggtcagtaatcggccctcaggggtttctgccggcactctcagagagtgttcggcgcagggaccaaggtgaccgtcacaggtcagcccaaggctgccccctcggtcactctgttcccaccctcctcgtactagacg

SEQ ID NO: 788223 - DNA, 452 bp, Homo sapiens
  misc_feature: NA.49.84.H07.1.454.light.4.zerom50
tcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccgtcctaggtcagcccaaggctgccccctcggtta

SEQ ID NO: 788224 - DNA, 424 bp, Homo sapiens
  misc_feature: NA.49.84.H07.2.454.light.4.zerom50
ctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgtcctgagtcagcccaac

SEQ ID NO: 788225 - DNA, 443 bp, Homo sapiens
  misc_feature: NA.16.78.H01.1.454.light.4.zerom50
aggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtt

SEQ ID NO: 788226 - DNA, 436 bp, Homo sapiens
  misc_feature: NA.52.9.A09.1.454.light.4.zerom50
agggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaagccagggaaagcccctaaactcctgatctctgctgcatctagtttgcatactgaggtcccatccaggttcagtggcggtggatctgggacagatttcactctcaccatcagcagtctgcaacctgaagattttgcaacttactactgtcaacagggttacggaaccctgctcatcttcggcggagggaccaaaggtggagatcaaacgaactgtggctga

SEQ ID NO: 788227 - DNA, 443 bp, Homo sapiens
  misc_feature: NA.52.9.A09.2.454.light.4.zerom50
aagggkgatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaaatcagcagagtggaggctgaggatgttggggtttattactgcatgcaagttctacaaaatcctcgcacttttggccaggggaccaagctggagatcaaacgaactagtgg

SEQ ID NO: 788228 - DNA, 456 bp, Homo sapiens
  misc_feature: NA.47.50.E06.1.454.light.4.zerom50
agagaagacaggattcaggacaatctccagcatggccggcttccctctcctcctcaccctcctcactcactgtgcagggtcctgggcccagtctgtgctgactcagccaccctcagcgtctgggacccccgggcagagggtcactatctcttgttctggaagcagctccaacatcgaaaaaaattttgtatactggtatcagcaactcccaggaacggcccccaaactcctcatgtctaggaataatcagcggccctcaggggtccctgaccgattctctggctccaagtctggcacctcagcctccctggccatcagtgggctccggtccgaggatgaggctgattattactgtgcagcatgggatgacagcctgcctggtcattgggtgttcgggcggagggaccaagctgaccgtcctaggtcagcccaaggctcgccccctcggtcacttcs

SEQ ID NO: 788229 - DNA, 458 bp, Homo sapiens
  misc_feature: NA.53.58.F03.1.454.light.4.zerom50
aagggaaaggggctgggcctcaggaagcagcatcggaggtgcctcagccatggcatggatccctctcttcctcggcgtccttgcttactgcacaggatccgtggcctcctttgagttgactcagccgccctcagtgtccgtgtccccaggacagacagccagcatcacctgctctggagataagttgggggataaacatacttcctggtatcaacagaagccaggccagtcccctctcctggtcatgtatcaagataccaagcggccctcagggatccctgagcgattctctggctccaactctgggaacacagccactctgaccatcagcgggacccaggctatggatgaggctgactattactgtcaggcgtgggacagcagcccaaattgggtgttcggcggagggaccaagctgaccgtcctaggtcagcccaaggctgccccctcggtcctac

SEQ ID NO: 788230 - DNA, 463 bp, Homo sapiens
  misc_feature: NA.53.58.F03.2.454.light.4.zerom50
aagggaaagggggtgggtccaggaggcagaactctgggtgtctcaccatggcctggatccctctacttcyycccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagacggccctcagggatccctgagcgattctctggctccaggtcagggacaacggtcacattggccatcagtggagtccaggcagaggacgagggctgactattattgtcaatcaacagacaccattggtacttatgtcttcggaactgcgaccaagkwcaccgtcykggtcagcccaaggacccaaccccactcgtcactctcg

SEQ ID NO: 788231 - DNA, 430 bp, Homo sapiens
  misc_feature: NA.4.51.E07.1.454.light.4.zerom50
aggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaggagcaacttagcctggtaccagcataaacctggccaggctcccaggctcctcatctatggtgcatccaccagggccactggtatcccagccacgttcagtggcagtgggtctgggacacagttcactctcaccatcagcagcctgcagtctgaagattttggagtttattactgtcagcagtataataactggcctctcactttcggcggagggaccaaggtggagatcaaacgaactgtggctgcacc

SEQ ID NO: 788232 - DNA, 476 bp, Homo sapiens
  misc_feature: NA.14.19.B08.1.454.light.4.zerom50
aaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccaccctcctcgs

SEQ ID NO: 788233 - DNA, 446 bp, Homo sapiens
  misc_feature: NA.21.52.E08.1.454.light.4.zerom50
agagagaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtattttttacagccccaccaataagagctacttagcttggttccagcacaaaccaggacagcctcctgtaatgctcatttactgggcgtctacccgggaatatggggtccctgaccgattcagtggcagcgggtctgggacagatttcactctcaccatcagcagcctgcaggctgaagatgtggcagtttattactgtcagcaatattatatttctcctcagacgttcggccaagggaccagggtggaaatcaaacgaa

SEQ ID NO: 788234 - DNA, 437 bp, Homo sapiens
  misc_feature: NA.3.52.E08.1.454.light.4.zerom50
gtcggcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaacgcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggagatcaaacgaactgtgg

SEQ ID NO: 788235 - DNA, 482 bp, Homo sapiens
  misc_feature: NA.8.20.B09.1.454.light.4.zerom50
agggagcaccgtggagaagacagtggcccctacagaatgttcataggttctcatccctcaccccccaccacgggagactagagctgcaggatcccaggggaggggtctctcctcgctcactgcacagggtcctgggcccagtctgtgctgacgcagccgccctcagtgtctggggccccagggcagagggtcgccatttcctgcactgggacgagctccaacatcggggcaggttatgatgtacactggtaccggcacctcccaggagaagcccccaaactcttcatctggggtaacaccaatcggccctcaggggtccctgaccgagtctcaggctccaagtctggcacctcagcctccctggccgtctcggggctccaggctgaggatgagggtgattattactgcctgtcctatgacaacagcctgaatatatgggtgttcggcggagggaccaaactgaccgtcctcagtcagacccg

SEQ ID NO: 788236 - DNA, 464 bp, Homo sapiens
  misc_feature: NA.43.82.H05.2.454.light.4.zerom50
cacgaccggtgctcgatttagtacacacacttagggattgggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcacg

SEQ ID NO: 788237 - DNA, 506 bp, Homo sapiens
  misc_feature: NA.43.82.H05.3.454.light.4.zerom50
cacgaccggtgctcgatttagtcgagctctctcgcgggcacgaccggtgctcgatttagtryrmryasttcmgsgrkkggskggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaasyagcagtgacgttggwrsttatracyatgtctcctggtaccaacaayacccaggcaaacgcccccaaactcwtgatttatgatgtcaastwatcggccctcaggggtttctwatcgcttctctggctccaagtctggcaacacggcctccctgaccatctctgggctccaggctgaggacgaggctgattattactgcarctcacttacaacgaccgacacttgcgtattcggcggcgggaccaagctgtacccg

SEQ ID NO: 788238 - DNA, 312 bp, Homo sapiens
  misc_feature: NA.4.67.G01.1.454.light.4.zerom50
tttggttactatgactttgtctcgtggtaccaacaacacccaggcaaagcccccaaactcataatttatggtgtcactaagcggccctcaggggtccctgatcgcttctctggctccaagtctggcaacatggcctccctgaccatctctgggctccaggctgaggatgaggctgattactactgctgctcctttgcaggcgcctctgtctcaggcagctatgtcttcggaactgggaccgaagtgaccgtcctgggtcagcccaaggccaaccccactgtcactctgttcccgccctcctcctacagtgct

SEQ ID NO: 788239 - DNA, 437 bp, Homo sapiens
  misc_feature: NA.51.68.G02.1.454.light.4.zerom50
ctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagcccaaggctcgtccccccg

SEQ ID NO: 788240 - DNA, 550 bp, Homo sapiens
  misc_feature: NA.51.68.G02.2.454.light.4.zerom50
ttgagaacctatgaacattctgtaggggccactgtcttctccacggtgctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcgggacagggtatgatgtacactggtaccagcagcttccaggaacagcccccaaactcctcatttattctaacacccatcggccctcaggggtccctgatcgattctctggctccaagtctggcacctcagcctccctggccatcactggactccaggctgaggatgaggctgattattactgccagtcctatgacatcagcctgagtggttcgtgggtattcggcggagggaccagactgtacccgtcctaagtcagcccaaggctgccccctcggtcactctgttcccgccctcctctcgtagcact

SEQ ID NO: 788241 - DNA, 483 bp, Homo sapiens
  misc_feature: NA.51.68.G02.3.454.light.4.zerom50
aagagctgctcagttaggacccagagggaaccatggaaaccccagcgcagcttctcttcctcctgctactctggctcccagatactaccggagaaattgtgttgacgcaatcgccaggcaccctgtctttgtctccaggggagagagccaccctctcttgcagggccagtcagactattggcatcaactacctagcctggtaccaacagaagcctggccaggctcccagactcctcctttttggtgcatccagcagggccactggcgtcccagacaggttcaggtggcaggtgggtctgggacagacttcgctctcaccatcagcagagtggagcctgaagtattttgcagttgtattactgtcagcagtataatctactacctcggacgttcggyccgacgggaccgaacggtagggaaagtaccaaaacgaaaccgtagtaggccgtggcaccactctcgtcttcwmtcttcccgtcccta

SEQ ID NO: 788242 - DNA, 446 bp, Homo sapiens
  misc_feature: NA.51.68.G02.4.454.light.4.zerom50
caggagtcagtcycagtcaggacacagcatggacatgagggtccccgctcagctcctggggctcctgctrctctggctccsaggtgccagatgtgacatccagwtgacccagtctccatcctycctgtctgcatctgtaggagacagagtcaccatcacttgccgggcmagtcagrgcattagcatttctttagcctggtatcagacaaaaaccagggaaagccccctaagctcctgatctatgctgcatccactttgcaaactggagtcccatcaaggttcagcggcagtggatctgggacagaattcactctcacaatcagcagcctgcagcctgaagtattttgctaacttattactgtacaacagtactttaatacttatcctcggtaccgttcggccgaacgggaccgaaggtaggaaatacaaacgaactagtgctgcac

SEQ ID NO: 788243 - DNA, 462 bp, Homo sapiens
  misc_feature: NA.40.52.E08.1.454.light.4.zerom50
agagagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaactagcagtgacattggtgcttataactatgtctcctggtaccaacaacacccaggcgaggcccccaaactcatgatttatgatgtcaataatcggccctcaggggtttctaatcgcttctctggctccaagtctggcaacacggcctccctgaccatctctgggctccaagctgaggacgaggctgtttatttctgcagctcatatacaagcagcaacactctggtgttcggcggagggaccaagctgaccgtcctavgtcagcccaaggctcgccccccg

SEQ ID NO: 788244 - DNA, 455 bp, Homo sapiens
  misc_feature: NA.52.56.F01.2.454.light.4.zerom50
aacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtacttcggaactgcgaccaaggtcaccgtcctgggtcagcccaaggccaacccccactgt

SEQ ID NO: 788245 - DNA, 438 bp, Homo sapiens
  misc_feature: NA.5.4.A04.1.454.light.4.zerom50
agggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggacaagtcagagcattagcaggtctttaaattggtatcagcacaaaccagggaaagcccctatgctcctgatctttgctgcatccagtttgcaaagtggggtcccatcaaggttcagtggcagtggatctgggacagatttcactctcaccatcagcagtctgcaagctgaagattttgcaacttattactgtcaacaaagttatagtaccccgacgttcggccaagggaccaamggtggagatcaaacgaactagtggctgcaccactcg

SEQ ID NO: 788246 - DNA, 458 bp, Homo sapiens
  misc_feature: NA.52.65.F10.1.454.light.4.zerom50
agggggcaggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgtcgggcgagtcaggttgttagcgcctggttagcctggtatcagcagaaaccagggaaagcccctaaagtcctggtctatgctacatccaatttgcaaagtggcgtcccctcaaggttccgcggcagtggatctgggacaaatttcactctcaccatcagcagcctgcagcctgaagattttgcgacttactattgtcaacaggggtacagttttccgtacacctttggccaggggactaagctggacatcaaacgaactgtggctgcaccatctgtcttcatcttccccg

SEQ ID NO: 788247 - DNA, 464 bp, Homo sapiens
  misc_feature: NA.48.3.A03.2.454.light.4.zerom50
gatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaaccccactgtcta

SEQ ID NO: 788248 - DNA, 460 bp, Homo sapiens
  misc_feature: NA.40.48.E04.1.454.light.4.zerom50
ctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccaagctgaccgtcctaggtcagcccaaggctgccccctcggtcactctcg

SEQ ID NO: 788249 - DNA, 423 bp, Homo sapiens
  misc_feature: NA.40.48.E04.2.454.light.4.zerom50
aagtctctctcagtcaggacacagcatggacatgagggtccctgctcagctcctgggactcctgctgctctggctcccagatactagatgtgacatccagatgacccagtctccaccctccctgtctgcatctgtcggagacaaagtcaccatcacttgccgggcgagtcaagtcattagcaattatttagcctggtatcagcagaaaccagggcaaggtcctaaactcctgatctacgctgcatccactttgcactcaggggtcccatctcggttcaccggcagtggatctgggacagatttcactctcatcatcagcagcctgcagcctgaggatgttgcaacttattactgtcaaaagtataacattgcccccttcaccttcggccaagggacacgactggagattaaacgaactgtggt

SEQ ID NO: 788250 - DNA, 413 bp, Homo sapiens
  misc_feature: NA.40.48.E04.3.454.light.4.zerom50
cacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatc

SEQ ID NO: 788251 - DNA, 313 bp, Homo sapiens
  misc_feature: NA.3.11.A11.1.454.light.4.zerom50
aagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgaactgtggctgcaccatctgtcttcatcttcccgccatctgagagtgcgtct

SEQ ID NO: 788252 - DNA, 470 bp, Homo sapiens
  misc_feature: NA.13.73.G07.2.454.light.4.zerom50
aggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaaccccactgtcactctgttcccga

SEQ ID NO: 788253 - DNA, 456 bp, Homo sapiens
  misc_feature: NA.43.13.B02.1.454.light.4.zerom50
tccgcggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaacgctgccccctcggtcactcc

SEQ ID NO: 788254 - DNA, 449 bp, Homo sapiens
  misc_feature: NA.43.13.B02.2.454.light.4.zerom50
tccgcgggcacgaccggtgctcgatttagagtagtgatcaggggggaagagctgctcagttaggacccagagggaaccatggaaaccccagcgcagcttctcttcctcctgctactctggctcccagtctcagatatcaccggagaaattgtgttggcgcagtctcctggcaccctgtctttgtctccaggggagagagccacgctctcttgcagggccagtcagagtatcagtagcaactacttaacctggtaccagcagaaatctggccaggctcccaggctcctcatctacagtgcgtccaggagggcctctggcatcccagacaggttcagtggcagtgggtctgggacagacttcactctcaccatctccagactggagcctgaagattttgcagtgtattactgtcagcaatatgatabctcaccgvtggacgttcggccaac

SEQ ID NO: 788255 - DNA, 457 bp, Homo sapiens
  misc_feature: NA.52.80.H03.1.454.light.4.zerom50
aagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgcttctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcactcc

SEQ ID NO: 788256 - DNA, 459 bp, Homo sapiens
  misc_feature: NA.52.24.C02.3.454.light.4.zerom50
tagggaaagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgcttctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtctact

SEQ ID NO: 788257 - DNA, 476 bp, Homo sapiens
  misc_feature: NA.46.67.G01.2.454.light.4.zerom50
ttgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagttttccctgacgctgacgtctgtgaccgccgcagacacggctgtctattattgtgcgagactagccttctgtagtgggggtacttgcaacccgggatactactccaccttcggcttggacatctggggccgac

SEQ ID NO: 788258 - DNA, 477 bp, Homo sapiens
  misc_feature: NA.52.24.C02.1.454.light.4.zerom50
tagggaaaggggaagaaatacctgcaactgttagggaaaggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcacctgcactctgagtagagggcacagcaactacgccatcgcatggcatcagcagcagccagagaagggccctcgatacttgatgatgttttatagtgatgggagtcacatcgaagggggacgggatccctgctcgcttctcaggctccagctctgggactgggcgccacctcatcatctccagcctccagtctgaggatgaggctgattattactgtcagacctggggcactggcagttcgggtcttcggcggagggaccaaactgaccgtcctaggtcagcccaaggtccg

SEQ ID NO: 788259 - DNA, 444 bp, Homo sapiens
  misc_feature: NA.52.24.C02.2.454.light.4.zerom50
tagggaaaggggagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcggcgggggaccaaggtggagatcaaacgaactgtggctgcaccatctgtctt

SEQ ID NO: 788260 - DNA, 448 bp, Homo sapiens
  misc_feature: NA.12.88.H11.1.454.light.4.zerom50
aacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggccaggggaccaagctggagatcaggcgtaacg

SEQ ID NO: 788261 - DNA, 455 bp, Homo sapiens
  misc_feature: NA.51.84.H07.1.454.light.4.zerom50
aggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatacaaacgaactgtggctgcaccatctgtcttctatcttccccg

SEQ ID NO: 788262 - DNA, 457 bp, Homo sapiens
  misc_feature: NA.9.22.B11.1.454.light.4.zerom50
aggggagctctgcttcagctgtgagcgcagaaggcaggactcgggacaatcttcatcatgacctgctcccctctcctcctcacccttctcattcactgcacagggtcctgggcccagtctgtggtgacgcagccgccctcagtgtctgcggccccaggacagagggtcaccatctcctgctctggaaacctcaccaacattgagagcaattatgtttcctggtaccagcagctcccaggaagagcccccaaactcctcatctatgacaatgataaacgaccctcagggattcctgaccgtttctctgcctccaagtctggctcgtcagccaccctggccatcaccggactccagactggggacgaggcccattattactgcggaacatgggattacaggttgagtgttggggctttcggcggagggaccgagctgagcgtcctaggtcagcccaagg

SEQ ID NO: 788263 - DNA, 427 bp, Homo sapiens
  misc_feature: NA.17.50.E06.1.454.light.4.zerom50
caggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcaggccattagcagctatttaaattggtatcagcagaaaccagggaaagcccctaagctcctgatctatgctgcatccagtttgcaaagtggggtcccattaaggttcagtggcagtggatctgggacagatttcactctcaccatcagcagtctgcaacctgaagattttgcaacttactcctgtcaacagagttacagtaccccgtttcacttttggccaggggaccaagctggagatcaaacgaactagtgg

SEQ ID NO: 788264 - DNA, 436 bp, Homo sapiens
  misc_feature: NA.15.28.C06.1.454.light.4.zerom50
agtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcattcccg

SEQ ID NO: 788265 - DNA, 452 bp, Homo sapiens
  misc_feature: NA.48.43.D10.2.454.light.4.zerom50
agggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggacagtaagcggccctcaggggtttctaatcgcttctctggctccaagtctggcaacacggcctccctgacaatctctgggctccaggctgaggacgaggctgattattactgctgctcatatgcagatagtagcactcatgtggtattcggcggagggaccaagctgaccgtcctaggtcagcccaaggctccg

SEQ ID NO: 788266 - DNA, 452 bp, Homo sapiens
  misc_feature: NA.48.43.D10.1.454.light.4.zerom50
agggggctggtcacacttcttgcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggccccatcgaggttcagcggcagtggatcagggacagagttcactctcaccatcagcagcctgcagcctgaagattttgcaacttattactgtcaacactttaacaattaccctcataagccgttcggccaagggacccaggtaggaaaccaagcgaactgtggc

SEQ ID NO: 788267 - DNA, 495 bp, Homo sapiens
  misc_feature: NA.48.43.D10.3.454.light.4.zerom50
agggaaagggggggggagsswarskgkgctgtgggtccaggaggcagaactctgggtgtctcaccatggcctgggtccccctacttctcccccctcctcactctctgcacaggctctcaggcctcctatgagttgacacagccaccctcggtgtcagtgtccccaggacagacggccaggatcacctgctctggagatggattgccaacacaatatgcgtactggtaccagaagaagccaggccaggcccctgttttggtgatatatcaagacactcagagggcctcagggacccctgagcggttctctggctccagctcaggggcaacagtcgcgttgacaatcagggaagtccaggcagaggacgaggctgactattactgtcagtctgcagacaacggaggtacttacttggtcttcggcggagggaccgaagttgaacgtcctgggtcagcccaaggctcgccccctcggtctactctgttcccgcctcct

SEQ ID NO: 788268 - DNA, 379 bp, Homo sapiens
  misc_feature: NA.10.39.D06.2.454.light.4.zerom50
cagttctttgggggagagactgaagaacccagcattgcagcagctccaccatggcctgggctcctctgctcctcaccctcctcagtctcctcacagggttgactcagccaccttctgmatcagcctccctgggagcctcggtcacactcacctgcaccctgaacagcgactacatcttgggctcaggcctcaatcggtgcctgaccaccaacaacatctacgaagagggtgagagtgtccctcactgtggggcagacaatggcagtgggagcaatttcgtgagagtgttcggcggagggaccaacctgaccgtccttcctaggtcagcccaaggctgccccctcggtcactctcgttcccaccctcctccactactatg

SEQ ID NO: 788269 - DNA, 468 bp, Homo sapiens
  misc_feature: NA.10.39.D06.1.454.light.4.zerom50
ggcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgaggccggggatgaggccgactactactgtcaggtgtgggatttcactactgatcatgtgggggtcttcggcggagggaccaagctgaccgtcctaagtcagcccaaggctgccccctcggtctaccg

SEQ ID NO: 788270 - DNA, 459 bp, Homo sapiens
  misc_feature: NA.8.71.G05.2.454.light.4.zerom50
tgaggtgaaagatgagctggaggaccgcaataggggtaggtcccctgtggaaaaagggtcagaggccaaaggatgggagggggtcaggctggaactgaggagcaggtgggggcacttctccctctaacactctcccctgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcycgccatctgagacacgcgag

SEQ ID NO: 788271 - DNA, 435 bp, Homo sapiens
  misc_feature: NA.12.31.C09.1.454.light.4.zerom50
caggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagagttaccgcgctcccatcactttcggccaagggacacgaccgcagattggacgaactgtggctgcaccatt

SEQ ID NO: 788272 - DNA, 466 bp, Homo sapiens
  misc_feature: NA.4.28.C06.1.454.light.4.zerom50
ctgggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttgggggagagatatgtttcctggtatctccagaggccaggccactcccctattctagtcatgtatcaaactacgaagcgcccctcaggggtccctgagcgcttttctggctccaagtctggggacacagccactctgactctctccggggcccaggccatcgatgagggagactattactgtcaggcgtgggacagcacaactgcagtcttcggcggagggaccagggtgaccgtcctgggtcagcccaaggctgccccctcggtcactctcgttcccaccctcctcctaccg

SEQ ID NO: 788273 - DNA, 470 bp, Homo sapiens
  misc_feature: NA.48.88.H11.2.454.light.4.zerom50
aacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctggggtccctcctcgattctctggctccatcgacaggtcctccaactccgcctccctcttcatctctgaactgaagactgaggacgaggctgcttattactgtcagtcctctgatggcagcgcagttgtcttcggcggagggaccacactgaccgttatcggtcagcccaaggctgccccctcggtcactctcg

SEQ ID NO: 788274 - DNA, 436 bp, Homo sapiens
  misc_feature: NA.40.84.H07.2.454.light.4.zerom50
ctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatggggacggcagcctcagtgaatgggtgttcggcggagggaccaaactgtccgtcctaggtcacg

SEQ ID NO: 788275 - DNA, 446 bp, Homo sapiens
  misc_feature: NA.11.31.C09.1.454.light.4.zerom50
cagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcgggtctgggacagatttcactctcacaatcagcagcctgcagactgaagatgtgggcgtttattattgtcaacaatattctcttgttccgtttaatttcggcggagggaccaaggtggagatcaaacgaactgtggctgcaccatctgtcttcatcttcccgccat

SEQ ID NO: 788276 - DNA, 452 bp, Homo sapiens
  misc_feature: NA.3.67.G01.1.454.light.4.zerom50
tttgggtttggggaggaactgctcagttaggacccagagggaaccatggaagccccagctcagcttctcttcctcctgctactctggctcccagatattaccggagaaattgtgttgacacagtctccagtcaccctgtctctggctccaggggaaagagccaccctctcctgtagggccagtcagagtgttgccactcacttagcctggtaccagcagaaacctggccaggctcccagactcctcatctatgatgcatccaacggggccactggcatcgcagccaggttcagtggcagtgggtctgggacagacttcactctctccatcaggaatctggagcctgaagattctgcaatttatttctgtcagcagcgtagcagctggcctcccactttcggcggagggaccgaaggtggagatcaaacgaactgtggctgcaccatctgttt

SEQ ID NO: 788277 - DNA, 337 bp, Homo sapiens
  misc_feature: NA.12.66.F11.1.454.light.4.zerom50
aagggaaagagccaccctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcaccatcaccagactgcagtctgatgattttgcactttattactgtcagcactataataattggcctccggagtacacctttggccaggggaccaagctggagatcaaacgaactgtggctgcaccatctgtcttcatcttcccgccatctgatacgtcgtat

SEQ ID NO: 788278 - DNA, 443 bp, Homo sapiens
  misc_feature: NA.5.26.C04.1.454.light.4.zerom50
aggaactgctcagttaggacccagacggaaccatggaagccccagcgcagcttctcttcctcctgctactctggctcccagataccactggagaaatagtgatgacgcagtctccagccaccctgtctgtgtctccaggggaaagagccacactctcctgcagggccagtcagagtgttagtggccgcttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataacgactggtggacgttcggccaagggaccaaggtggaaaccaaacgaactgtggctgcaccatctgtcttctattcc

SEQ ID NO: 788279 - DNA, 434 bp, Homo sapiens
  misc_feature: NA.46.26.C04.1.454.light.4.zerom50
tgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaactw

SEQ ID NO: 788280 - DNA, 441 bp, Homo sapiens
  misc_feature: NA.13.3.A03.2.454.light.4.zerom50
agagaggaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaacccctaagctcttgatctatggtgcatccagtttaaaaagtggggtcccatcaaggttcagcggcagtggatctggcacagacttcattctcaccatcagcagcctgcagcctgragtttttgcaacttattactgtctacaagatcacaattatcctgggacgttcggccragggaccaaggtggaaatcaaacgaactaggtggt

SEQ ID NO: 788281 - DNA, 461 bp, Homo sapiens
  misc_feature: NA.4.21.B10.2.454.light.4.zerom50
agagrrgaggggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccgccatcagctgcaagtccagccagagtgttttattcagctccaacaataagaactacttagcttggtaccagcagaaaccaggacagcctcctaacctgctcatttactgggcatctacccgggaatccggggtccctgaccgattcagtggcagcgggtctgggacagatttcactctcaccatcaacagcctgcaggctgaagatgtggcagtttattactgtcagcagtattatataactcccttcactttcggcggasggaccgaaggtcggagactacaaacgaacctgtggctcg

SEQ ID NO: 788282 - DNA, 479 bp, Homo sapiens
  misc_feature: NA.13.3.A03.1.454.light.4.zerom50
aaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaaccccactgtcactctgttcccgabmctcctc

SEQ ID NO: 788283 - DNA, 443 bp, Homo sapiens
  misc_feature: NA.49.25.C03.1.454.light.4.zerom50
aggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgtt

SEQ ID NO: 788284 - DNA, 471 bp, Homo sapiens
  misc_feature: NA.19.26.C04.2.454.light.4.zerom50
tgagggttgagaacctatgaacattctgtaggkgccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctgggaacacggccaccctgaccgtcagcagggtcgaagccggggatgaggccgactattactgtcaggtgtgggatagtagtagcggtcatgtgagttttcggcggtagggaccaagctgaccgtcctaggtcagcccaaggctcgccccctcggtcactcctgttccccrccctcctcccacgagagta

SEQ ID NO: 788285 - DNA, 419 bp, Homo sapiens
  misc_feature: NA.41.48.E04.1.454.light.4.zerom50
ctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtccttmggt

SEQ ID NO: 788286 - DNA, 466 bp, Homo sapiens
  misc_feature: NA.49.25.C03.4.454.light.4.zerom50
agtcagtcccaaccaggacacagcatggacatgagggtccctgctcagctcctggggctcctgctgctctggctctcaggtgccagatgtgwcatccagatgacccagtctccatcctccctgtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccrctcactttcggcggagggaccgaaggtggagatcaaacgaactgtggctgcaccatctgtcttcatcttccssccatctgatctctcgact

SEQ ID NO: 788287 - DNA, 445 bp, Homo sapiens
  misc_feature: NA.49.25.C03.5.454.light.4.zerom50
aggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagartgttrgsagcwacttagcctggtaycagcagaaacctggccaggctcccagkctcctcatctwtgrtgcatccmscagggccrctgryatcccagccaggttcagtggcagtgggtytgggacagasttcackctcaccatcagcagcctrsagyctgaagattttgcagtttattactgtcarcagyrtaatsymcrggmtccggwcactttcggcsswgggaccarrgtggakatcaaacgaactgtggctgcaccatctgtcttcta

SEQ ID NO: 788288 - DNA, 441 bp, Homo sapiens
  misc_feature: NA.52.68.G02.1.454.light.4.zerom50
ctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggcaccaacagtgattttggtggttatgattctgtcttctggtaccaacggcacccaggcaaagtccccaaactcatgattactgatatcaataagaggccctcaggggtccctgatcgcttctctggctccaagtctggcaacacggcctccctgaccatctctgggctccaggctgaggatgaggctgaatatttctgctgctcatatgcaggcggctacacttatgtcttcggaactgggacccaggtcaccgtcctaggtcagcccamgga

SEQ ID NO: 788289 - DNA, 455 bp, Homo sapiens
  misc_feature: NA.4.36.D03.1.454.light.4.zerom50
aatctctcttggggagtcagactcagtcaggacacagcatggacttgagggtccccgctcagctcctggggctcctgctgctctggctcccaggtgccaaatgtgacatccagatgacccagtctccttccaccctgtctgcatctgtgggggacagagtcaccatcacttgccgggccagtcagagtgttgataactggttggcctggtatcagcagaaaccagggaaagcccctaaactcctgatttatgatgcctccggtttggaaagtggggtcccatcaaggttcagcggcagtggatctgggacagaattcactctcaccatcagcagcctgcagcctgatgattttgcaacttattactgccaacagtattatagttattctttgacgttcggccaagggaccaaggtggaaatcaaacgaactgtggctgcaccatctgtcttctac

SEQ ID NO: 788290 - DNA, 437 bp, Homo sapiens
  misc_feature: NA.52.68.G02.3.454.light.4.zerom50
aagagctgctcagttaggacccagagggaaccatggaaaccccagcgcagcttctcttcctcctgctactctggctcccagatatcaccggggaaattgtgttgacgcagtctccaggcaccctgtctttgtctccaggggaaagagtcaccctctcctgcagggccagtcagagtgttctcgccagctacttagcctggtaccagcagaaacctggccaggctcccaggctcctcatctatgcttcatccagcagggccgctggcatcccagacaggttcagtggcagtgggtctgggacagacttcactctgaccatccgcagactggagcctgaagattttgcggtgtattattgtcagcactatgatacctcactcatgtactacttttggccaggggaccaagctggagatcaaacgaactgtggctgcacc

SEQ ID NO: 788291 - DNA, 449 bp, Homo sapiens
  misc_feature: NA.52.68.G02.4.454.light.4.zerom50
tctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttttgatgtacactggtaccagcagcttccgggaacagcccccaaactcctcatctttggtaacagcaatcggccctccggggtccctgaccgattctctggctccaagtctggcacctcagcctccctggccatcactgggctccaggctgaggatgaggctgattattactgccagtcctatgacagcagcctgagtgtcttttgggtcttcggaactgggaccaaggtcaccgtcctasgtcacg

SEQ ID NO: 788292 - DNA, 468 bp, Homo sapiens
  misc_feature: NA.40.58.F03.1.454.light.4.zerom50
gaaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacaccgccatgaacaaggagtacttggcttggttccagcagaaagcagggcagccccctaagctgctcatttactcggcatccacccggaaatccggagttcctgaccgattccgtggcagcgggtctgggacagattttactctcaccatcagtagcctgcagactgaagatgtggcagtttattactgtcaacaatattttcatactccgccgacgttcggccggggaccgaacgtggaaatcaaacgaactagtggctgcaccatctgtt

SEQ ID NO: 788293 - DNA, 453 bp, Homo sapiens
  misc_feature: NA.47.36.D03.1.454.light.4.zerom50
atctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacagggtaacagtttcccgctcaccttcggcggagggaccaaggtggagatgaaaagaactgtggctgcaccattytcg

SEQ ID NO: 788294 - DNA, 436 bp, Homo sapiens
  misc_feature: NA.52.43.D10.2.454.light.4.zerom50
aggggagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagcaaaaagtagggacagcccctaaactcctgatcctcgatgcatccactttggagacaggggtcccatcaaggttcagtggaagtggctctgggacagattttactttcaccatcagcaggctgcagcctgaagatgttgcaacatattactgtcaacagtataatcgtctcccgctcactttcggcgggggaccgaaggtggagatcaagcgaactgtggctgcaccatcttcg

SEQ ID NO: 788295 - DNA, 484 bp, Homo sapiens
  misc_feature: NA.12.5.A05.1.454.light.4.zerom50
aggggggggtctcaggaggcagcgctctcgggacgtctccaccatggcctgggctctgctattcctcaccctcctcactcagggcacagggtcctgggcccactctgccctgactcagcctgcctccgtgtctgggtctcctggacagtcgatcaccatctcctgcactgcaaccagcagtgacgttaatgataataactatttctcctggtaccagcaacacccaggcaaagcccccaaactcctcatttatggtgtcgggaatcggccctcaggggtttctaatcgcttctctggctccaagtctggcaaaacggcctccctgaccatctctggactccagcctgaggacgaggccgattactactgcattgcacagacaaggagtcccacttgggtgttcggcggagggaccaaactgaccgtcctaggtcagcccaaggctgccccctcggtcactctgttcccaccctcctctacgtcg

SEQ ID NO: 788296 - DNA, 435 bp, Homo sapiens
  misc_feature: NA.4.41.D08.1.454.light.4.zerom50
agtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaacttactattgtcagagttctaattctttcccgcgcacgtttggccaggggaccaaggtagagatcaaacgaactgtggctgcaccatcttcg

SEQ ID NO: 788297 - DNA, 452 bp, Homo sapiens
  misc_feature: NA.41.71.G05.1.454.light.4.zerom50
caggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaattaaacgaactgtggctgcaccatctgtcttcatcttcccgt

SEQ ID NO: 788298 - DNA, 444 bp, Homo sapiens
  misc_feature: NA.13.9.A09.2.454.light.4.zerom50
aggggctgggcctcaggaggcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagaccccaggccaaccc

SEQ ID NO: 788299 - DNA, 473 bp, Homo sapiens
  misc_feature: NA.15.5.A05.1.454.light.4.zerom50
aggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcgctacgtagacgtgagc

SEQ ID NO: 788300 - DNA, 464 bp, Homo sapiens
  misc_feature: NA.51.24.C02.3.454.light.4.zerom50
tagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctattcggcggagggaccaagctgaccgtcctaggtcagcccaaggctcgccccctc

SEQ ID NO: 788301 - DNA, 523 bp, Homo sapiens
  misc_feature: NA.3.3.A03.1.454.light.4.zerom50
agggcacgaccggtgctcgatttagagagcgtcacaggggagagtgttagagggagaagtgccagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccactggcatcccagccaggttcagtggcagtgggtctgggacagacttcactctcaccatcagtagcctagagcctgaagattttgcagtctattattgtcaacagcgtggcaactggccctcgtggacgttcggccaagggaccaaggtaggaaatacaaccgaactgtggctgcaccatctgtcttctattccccg

SEQ ID NO: 788302 - DNA, 452 bp, Homo sapiens
  misc_feature: NA.52.25.C03.2.454.light.4.zerom50
ctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtcacttccg

SEQ ID NO: 788303 - DNA, 450 bp, Homo sapiens
  misc_feature: NA.52.25.C03.3.454.light.4.zerom50
ctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactgtcactctcg

SEQ ID NO: 788304 - DNA, 468 bp, Homo sapiens
  misc_feature: NA.49.13.B02.1.454.light.4.zerom50
tccgcgggggtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgtttttcggcggagggaccaggctgaccgtcctgggtcagcccaaggctcgccccctcggtccactctgttcccccg

SEQ ID NO: 788305 - DNA, 432 bp, Homo sapiens
  misc_feature: NA.53.83.H06.1.454.light.4.zerom50
tcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagcgaccatcacctgttctggagacaaattgactgataaatatgctggctggtatcggcagaagccaggccagtcgcctgtgttggtcatctatcaggatagcaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgtcctgagtcagaccccg

SEQ ID NO: 788306 - DNA, 470 bp, Homo sapiens
  misc_feature: NA.10.88.H11.1.454.light.4.zerom50
aacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactgtggctgcaccatctgtcttcatcttcccgccatct

SEQ ID NO: 788307 - DNA, 444 bp, Homo sapiens
  misc_feature: NA.9.78.H01.1.454.light.4.zerom50
agagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtcttcta

SEQ ID NO: 788308 - DNA, 457 bp, Homo sapiens
  misc_feature: NA.48.51.E07.3.454.light.4.zerom50
tggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctggggtccctcctcgattctctggctccatcgacaggtcctccaactccgcctccctcttcatctctgaactgaagactgaggacgaggctgcttattactgtcagtcctctgatggcagcgcagttgtcttcgggcggagggaccacactgaccgttatcggtcagcccaaggctcgccccctcggtcactc

SEQ ID NO: 788309 - DNA, 446 bp, Homo sapiens
  misc_feature: NA.48.51.E07.5.454.light.4.zerom50
aagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgctaatttattactgtcaccagtatggtagctcaccytctaactttcggcggagggaccraggtaggagatacaaacgaactagtggctcgcaccatctgtt

SEQ ID NO: 788310 - DNA, 436 bp, Homo sapiens
  misc_feature: NA.48.51.E07.2.454.light.4.zerom50
aagacaatgggtttgatttagattacatgggtgacttttctgttttatttccaatctcagataccaccggagaaattgtgttgacgcagtctttaggcaccctgtctttgtctccagggaaaagagccaccctctcctgcagggccagtcagactgttagcagcagctactgagcctggtaccagctgaaacctggccaggctcccctgctcctcatctatggtgcatccagcagggccactggcatcccagacaggttcagtggcagtgggtctgggacagacttcactctcaccatcttcagactggagcctgaagattttgcagtgtattactgtcagcagtatggtaactcaacggaggacttttggccaggggaccaagctggagatcaaacgaactgtggctgcaccatctgtcttcatcttcccgccat

SEQ ID NO: 788311 - DNA, 478 bp, Homo sapiens
  misc_feature: NA.53.21.B10.2.454.light.4.zerom50
agagaggaggggggggggtctcaggaggcagcgctctggggacgtctccaccatggcctgggctctgctcctccgcacctcctcactcagggcacaggctcttgggcccagtctgccctgattcagcctccctccgtgtccgggtctcctggacagtcagtcaccatctcctgcactggaaccagcagtgatgttgggggttatgactatgtctccttataacaacaccaaccaggcacagtccaagcccatgctctacaatgtcaattctcggccctcagggggccctgatcgtctctctggctccaagtctggcaatacggcctccatgaccatctctggactccaggctgaggacgatactgattattactcctgctcaacaaacaagaagtgccaccttgggtccttcgggcggacgggaccaacctgacccgtcctaggtcagccctaacggctcgcccccgtcggctmcgta

SEQ ID NO: 788312 - DNA, 445 bp, Homo sapiens
  misc_feature: NA.47.77.G11.2.454.light.4.zerom50
aagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccat

SEQ ID NO: 788313 - DNA, 445 bp, Homo sapiens
  misc_feature: NA.53.29.C07.1.454.light.4.zerom50
agggaaagggggggcctcaggaagcagcatcggaggtgcctcagccatggcatggatccctctcttcctcggcgtccttgcttactgcacaggatgcgtggcctcctatgagctgactcagccaccctcagtgtccgtgtccccaggacagacagccagcatcacctgctctggagacaagttgggggataaatatgctggctggtatcagcagaagccaggccagtcccctgtgttagtcatctatcaagatacaaagcggccctcagggatccctgagcgattctctggctccaactctgggaacacagccactctgaccatcagcgggactcaggctatcgatgaggctgactattactgtcaggcgtgggacagccgcactkggggtgttcgggcggagggaccaagctgaccgtccgtgacgtcacgcccaaggstcccg

SEQ ID NO: 788314 - DNA, 457 bp, Homo sapiens
  misc_feature: NA.43.78.H01.1.454.light.4.zerom50
aagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccgccta

SEQ ID NO: 788315 - DNA, 458 bp, Homo sapiens
  misc_feature: NA.52.2.A02.2.454.light.4.zerom50
aggggaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagtgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctcgttcccrccctcctctatacgatcg

SEQ ID NO: 788316 - DNA, 563 bp, Homo sapiens
  misc_feature: NA.48.20.B09.1.454.light.4.zerom50
agggggggtgagggttgagaacctatgaacattctgtaggggccactgtcttctccacggtgctcccttcatgcgtgacctggcagctctgcttcagggtgaggaggagaggggagcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggagtaattatgtatcctggttccagcagttcccaggaacagcccccaaactcctcattcatgacactaataagcgaccctcaggcattcctgaccgattctctggctccaagtctggcacgtcagccaccctgggcatcaccggactccagactggggacgaggccgattattactgcggaacatgggaaggcagcctgagtgctacccagtgggtgttcggcggagggaccaagctgaccgtcctaggtcagcccaaggctgccccctcggtctacc

SEQ ID NO: 788317 - DNA, 446 bp, Homo sapiens
  misc_feature: NA.49.44.D11.1.454.light.4.zerom50
agggtttgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatcccggggtccctgagcgattcagtggcagcgggtctgggacagatttcactctcaccatcagcagcctgcagacgtgaagatgtggcagtgtattactgtcagcaatatcacactgctccgctcactttcgggcggagggaccgagggtggagatcaaacgaa

SEQ ID NO: 788318 - DNA, 449 bp, Homo sapiens
  misc_feature: NA.49.44.D11.2.454.light.4.zerom50
agggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaaactcctgatcctcgatgcatccactttggaaacaggggtcccatcaaggttcagtggaagtggctctgggacagtattttactttctaccatcagcaggctgcagcctgaagatattgcaacatattactgtcaacagtatgatagtctcccgcctcacgtttcggkcgggggaccgaaggtggagatacaagcgaacgtgtggctgcacca

SEQ ID NO: 788319 - DNA, 441 bp, Homo sapiens
  misc_feature: NA.52.32.C10.3.454.light.4.zerom50
tgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcta

SEQ ID NO: 788320 - DNA, 463 bp, Homo sapiens
  misc_feature: NA.49.26.C04.5.454.light.4.zerom50
ctgtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttcccgcctcct

SEQ ID NO: 788321 - DNA, 478 bp, Homo sapiens
  misc_feature: NA.49.26.C04.7.454.light.4.zerom50
ctggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgggatcggcccgcaggggtttctcatcgcttctccggctccaagtctggcagcacggcctccctgaccatctctgggctccaggctgaggacgaggctgattattactgcagctcatatacaaaacataaaacacttgggtgttcggcggcgggaccaaactgaccgtcctacgtcacgcccaaggctcgccccctcggtcactctcgttcccacsct

SEQ ID NO: 788322 - DNA, 461 bp, Homo sapiens
  misc_feature: NA.43.44.D11.2.454.light.4.zerom50
argggggggtcagacccagtcaggacacarcatgsacatgagggtccccgctcagctcctggggctyctgctgctctggctcccaggtgccagatgtgccatccagwtgacccagtctccrtcctccctgtctgyatcwgtaggagacaragtcaccatcacttgccgggcaagtcaggrcattrgaamygmwttagcctggtwtcwgcagaamccagggaaagcycctaagctcctsatctmtgstgcmtccactttrsaaartggrgtcccatcaagattcagcggyagtggatctggsacagmwttcactctcaccgtcagcagcctgcagyctgaagtattttgctaacttattactgtcaactagtttaaataactaccctctcactttcggaggagggaccagggtggagatacaaacgaactgtggctgcaccatctgtcttctatcttccccg

SEQ ID NO: 788323 - DNA, 440 bp, Homo sapiens
  misc_feature: NA.4.6.A06.2.454.light.4.zerom50
aggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtaattatgcatgttggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtgctcatgtggtattcggcggagggaccaagctgaccgtcta

SEQ ID NO: 788324 - DNA, 475 bp, Homo sapiens
  misc_feature: NA.3.59.F04.2.454.light.4.zerom50
tagggattggggagcttcagctgtgggtagagaagacaggactcaggacaatctccagcatggccagcttccctctcctcctcaccctcctcgctcactgtgcagggtcctgggcccagtctgtgctgactcaggcaccctcagcgtctggggcccccggacagagagtcaccattttttgttctggaagcagctccaacatcggaaggaataatgtaaactggtaccaacaccttccaggatcggcccccaaacacctcatctatagtaataatgagcgcccctcaggggtcccggtccgattctctggctccaggtctggcacctcagcctccctggccatcagtgggctccagtctgacgatgaggctgattattactgttcatcttgggattccaacctcaataatcggatattcggcggagggaccaagctgaccgtcctgggtcagcccaaggctgccccctcggtcta

SEQ ID NO: 788325 - DNA, 464 bp, Homo sapiens
  misc_feature: NA.13.81.H04.1.454.light.4.zerom50
tctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaactcataatttatgatttcactaatcggccctcaggtgtatctaatcgcttcactggctccaagtctggcaacacggcctccctgaccatctctgggctccaggcagaggacgaggctgattattactgcggctcctggacgattagcaccctttatgtcttcgggactgtgaccaaggtcaccgtcctaggtcagcccaaggcccaaccccactgtcactctgttccctata

SEQ ID NO: 788326 - DNA, 467 bp, Homo sapiens
  misc_feature: NA.13.36.D03.1.454.light.4.zerom50
atctctcttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaaccccactgtcta

SEQ ID NO: 788327 - DNA, 465 bp, Homo sapiens
  misc_feature: NA.13.36.D03.3.454.light.4.zerom50
atctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagtgtcaccatctcttgttctggaggcagtgccaacatcgggagtaattatgcattctggtatcaacaactcccaggaacggcccccagactcctcatctatagcaataaccagcggccctcaggggtccctgaccgattctctggctccaagtctggcacctcagcctccctggccatcagtgggctccggtccgacgatgaggctgattattactgttcagcttgggatgacagcctgaatacttgggttttcggcggagggaccaagttgaccgccctaggtcagcccaaggctccgg

SEQ ID NO: 788328 - DNA, 434 bp, Homo sapiens
  misc_feature: NA.3.28.C06.1.454.light.4.zerom50
cagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaagcccctaacctcctgatctatgatgcctccagtttggcaagtggggtcccatcaaggttcagcggcagtggatctgggacagaattcactctcaccatcagcagcctgcagcctgatgattttgcaacttattactgccaacagtataatacccgcgtgacgttcggccaagggaccraaggtggagatcatacgaactgtggctgcaccatctgtt

SEQ ID NO: 788329 - DNA, 443 bp, Homo sapiens
  misc_feature: NA.51.72.G06.3.454.light.4.zerom50
aggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccaaggtggaaatgaaaggaactgkkgctgcaccatctgtcttt

SEQ ID NO: 788330 - DNA, 431 bp, Homo sapiens
  misc_feature: NA.41.78.H01.1.454.light.4.zerom50
tgatcaggacttctcagttcatcttctcaccatgaggctccctgctcagctcctggggctgctaatgctctggatacctggatccagtgcagatattgtgatgtcccagactccactctctctgtccgtcacccctggacagccggcctccatctcctgcaagtctagtcagagtctcctccatgagaatggcaaaacttatttctactggtacctacagaaggcaggccagccgccacagctcctgatctatgaggttttcaggcggttctctggagtgccagacaggttcagtggcagcgggtccgggacagatttcacactgaggatcagtcgggtggaggctgacgacgttgggacttattactgcgcgcaaagtctacaccttcctctcactttgggccctgggaccaaagtggacatcaaacgaa

SEQ ID NO: 788331 - DNA, 467 bp, Homo sapiens
  misc_feature: NA.41.78.H01.3.454.light.4.zerom50
atagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctcgccccctcggtcactctcgttcccrt

SEQ ID NO: 788332 - DNA, 453 bp, Homo sapiens
  misc_feature: NA.12.12.B01.1.454.light.4.zerom50
tccgcggggacagcgaccatgttctgagggtcagactcaaacagcatcacccaggacaccgacaggagccggggcacaatgagagcctcacctgggaaatgcagccggaggcacctgggcccagatgtcagcctgggcagctcccacagtgctggaattccctggaagatgccccaaggttgagtctctgaggcctcctatgagctgacacagccaccctcggtgtcagtgtccccaggacaaacggccaggatcacctgctctggagctgcattgccaataaaatctccttattggtaccagcagaagtcaggccaggcccctgtattggtcatctatgaggacaacagacgaccttccgggatccctgagagattctctggctccacctcagggacaatggccaccttgactatcagtggcgcccaggtggaggatgaggctgacttaacg

SEQ ID NO: 788333 - DNA, 463 bp, Homo sapiens
  misc_feature: NA.40.28.C06.3.454.light.4.zerom50
agagccctggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgcc

SEQ ID NO: 788334 - DNA, 450 bp, Homo sapiens
  misc_feature: NA.47.86.H09.2.454.light.4.zerom50
ttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggccaggggaccaacctggagatcaaatgaactgtggctgcaccatctgtt

SEQ ID NO: 788335 - DNA, 488 bp, Homo sapiens
  misc_feature: NA.52.73.G07.2.454.light.4.zerom50
agggcacgaccggtgctcgatttagctctacgctcagggcacgaccggtgctcgatttagtakctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacavyattggtacttatgtgcagttcggmrgagggaaccg

SEQ ID NO: 788336 - DNA, 443 bp, Homo sapiens
  misc_feature: NA.4.11.A11.1.454.light.4.zerom50
aagggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcactatcacctgtcgggccagtcagaatattaatagttggttggcctggtatcaccagagaccaggagaagccccaaagctcatcatttatgatgcctccactttgaatggtggggtcccaccaacgttcagtggcagtggatctgggacagagttcactctcaccatcagcagcctgcagcctgatgatcttggaacttattactgccaacaatataataattattggacgttcggccaggggaccaaggtacgaaatagagacgaactgtggctgcaccatctgttcc

SEQ ID NO: 788337 - DNA, 465 bp, Homo sapiens
  misc_feature: NA.51.82.H05.3.454.light.4.zerom50
cacgaccggtgctcgatttagmygygcrtcgaagggwwwggggggggtctcaggaggcagcgctctcrggacgtcwccaccatggcctgggctctgctmytcctcaccctcctcactcagggcacagggtcctgggcccagtctgccctgactcagcctscctccgygtcygggtctcctggacagtcrrtcaccatctcctgcactggaaccagcagtgacgttggtggttataaytatgtctcctggtaccaacascacccaggcaaagcccccaaactcatgatttatgakgtcagtrakcggccctcaggggtyyckratcgcttctctggctccaagtcyggcaacacggcctccctgaccrtctctgggctccaggcygaggaygaggctgattattactgcwsctcayatrcargcagcawcrrtkkgstrttcggacggagggaccaagctgacccg

SEQ ID NO: 788338 - DNA, 446 bp, Homo sapiens
  misc_feature: NA.52.84.H07.2.454.light.4.zerom50
ctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattggggggaaaatatgcttgctggtatcaacagcggccaggccagtcccctgtactggtcatctatctgaatagtaggcggccctctgggatccctgaccgattctctggctcccactctgggaacacagccactctgaccatcagcgggacccaggctttggatgaggctgactattactgtcaggcgtgggacaccatcactggagtaataattcgggcggaggggaccaggctggaccgtcctaggtcagcccaaggcyygccccctcggt

SEQ ID NO: 788339 - DNA, 459 bp, Homo sapiens
  misc_feature: NA.19.72.G06.2.454.light.4.zerom50
tcgcaagaggcagcgctctcgggacgtctccaccatggcctgggctctgctgctcctcactctcctcactcaggacacagggtcctgggcccagtctgccctgactcagyctgcctccgtgtctgrgtctcytggacagtcgrtcaccatctcctscactggraccrgymgtgatgttggramttmtamccttgtctcctggtaccaacawyacccmrryaaagcccccaaactcmtsatttatgakgctcactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtccagcccaaggcccaaccccactgtcactcttcg

SEQ ID NO: 788340 - DNA, 435 bp, Homo sapiens
  misc_feature: NA.49.84.H07.3.454.light.4.zerom50
agtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaactcctgatctatgaggcgtctagtttagaaagtggggtcccttcaaggttcagcggcagtggatctgggacagaattcactctcaccatcaacagcctgcagcctgatgattttgcaacttattactgccaacactataatcattattctccggccactttcggccctgggaccaggctagatatcggacgaacgtgtggctgcacccat

SEQ ID NO: 788341 - DNA, 403 bp, Homo sapiens
  misc_feature: NA.10.76.G10.2.454.light.4.zerom50
agggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctccactactatg

SEQ ID NO: 788342 - DNA, 433 bp, Homo sapiens
  misc_feature: NA.52.56.F01.1.454.light.4.zerom50
aacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctccatacacttttggccaggggaccaagctggagatcagaaccg

SEQ ID NO: 788343 - DNA, 459 bp, Homo sapiens
  misc_feature: NA.46.67.G01.1.454.light.4.zerom50
ttgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgcaacttattactgtcaacagaattacaatgttttcggccaagggacacgactacaaattaaacgaactgtggctgcaccatctgtcttcatcttcccgccatctgtacgta

SEQ ID NO: 788344 - DNA, 429 bp, Homo sapiens
  misc_feature: NA.48.88.H11.1.454.light.4.zerom50
aacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtgggagacagagtcaccatcacttgccgggcaagtcagagcattagcagctatttaaattggtatcagcagaaaccagggaaagcccctaagctcctgatctatggtgcatccattttgcaaagtgggatcccatcagggttcagtggcagtgggtctgggacagatttcactctcaccatcagcagtttgcaacctgaagattttgcaacttactactgtcaacagagttacagtgaccgtacaattttggccaggggaccaagctggagatcaaacgaa

SEQ ID NO: 788345 - DNA, 448 bp, Homo sapiens
  misc_feature: NA.16.12.B01.2.454.light.4.zerom50
tcggcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtacttattattgccaacagtataagagttattcaactttcggccctgggaccaatcgtggatatcaaacgaactagtggctgcaccatctgtctta

SEQ ID NO: 788346 - DNA, 435 bp, Homo sapiens
  misc_feature: NA.49.25.C03.2.454.light.4.zerom50
agctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacgtaack

SEQ ID NO: 788347 - DNA, 469 bp, Homo sapiens
  misc_feature: NA.51.24.C02.1.454.light.4.zerom50
tagggaaaggggtgatcaggactcctcagttcaccttctcacaatgaggctccctgctcagctcctggggctgctaatgctctgggtcccagcatccagtggagatgttgtgctgactcagtctccactctccctgtccgtcacccttggacagccagcttccatctcctgcaggtctagtcaaagcctcgtttatagtgttggaaacacctacttgaattggtttcatcagaggccgggccaatctccaaggcgcctgatttataaggtttctaaccgggactctggggtcccagacagattcagcggcagtgggtcaggcactcatttcacactgaggatcagcagggtggaggctgaggatgttggggtttattactgcatgcaaggtacacactggcctcctatcaccttcggccaagggacacgactggaggttaaacgaactgtggctgcaccatctgtcttt

SEQ ID NO: 788348 - DNA, 442 bp, Homo sapiens
  misc_feature: NA.53.83.H06.2.454.light.4.zerom50
tcgcggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcacgttatgatgtacactggtaccagcaccttccaggagcagcccccaacctcctcctctctggtaacaccaatcggccctcaggggtccctgaccgattctctggctcgaagtctggcacctcagcctccctggccatcactggcctccaggctgaggatgaggctgattattactgccagtcctatgacagcagcctgaatgcttatgtcttcggaactgggacctaasgtcaccg

SEQ ID NO: 788349 - DNA, 457 bp, Homo sapiens
  misc_feature: NA.15.21.B10.1.454.light.4.zerom50
argagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccaccaaggttcagcggcagtgaatctgggacagatttcactctcaccatcagcagcctgcagcctgaggattttgcaacttactattgtcaacaggctaacagtttccctctcactttcggcggagggaccraaggtggatatcaaacgaactgtggctggcaccta

SEQ ID NO: 788350 - DNA, 446 bp, Homo sapiens
  misc_feature: NA.51.40.D07.1.454.light.4.zerom50
gtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacaggggtcccatcaaggttcagtggaagtggttctgggacagattttactttcaccatcagcagccttcaccctgaagatcttgcaacatattactgtcaacagtatgataatctcccactcactttcggcggagggaccaaggtggagatcaaacgaactgtggctgcaccat

SEQ ID NO: 788351 - DNA, 404 bp, Homo sapiens
  misc_feature: NA.14.76.G10.1.454.light.4.zerom50
agggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttccccaccctcctcgtactagacg

SEQ ID NO: 788352 - DNA, 446 bp, Homo sapiens
  misc_feature: NA.11.28.C06.1.454.light.4.zerom50
ctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccaaggtggagatcaaacgaactgtggctgca

SEQ ID NO: 788353 - DNA, 431 bp, Homo sapiens
  misc_feature: NA.41.50.E06.1.454.light.4.zerom50
tgatcaggactcctcagttcaccttctcacaatgaggctccctgctcagctcctggggctgctaatgctctgggtctctggatccactggggctgttgtgatgacacagtctccactctccctgcccatcacccctggcgagccggcctccatctcctgtaggtctagtctgagcctcctgtctagtagtggagacaactatttggattggtacctgcagaagccagggcagtctccacaactcctgatttatttgggttttcatcgggcctccggggtccctgacaggttcagtggcagtggatcaggcacagattttacactgagtatcagcacagtggaggctgaggatgttggggtttattattgtgtgcaaactctacactccacgtggacgttcggccacgggacgagggtggatatcaaacgaa

SEQ ID NO: 788354 - DNA, 449 bp, Homo sapiens
  misc_feature: NA.21.78.H01.1.454.light.4.zerom50
agtcagacccagtcaggacacagcatggacatgagggtccccgctcagctcctggggctcctgctgctctggctcccaggtgccaaatgcgacatccagatgacccagtctccttccaccctgtctgcatctgtaggagacagagtcaccatcacttgccgggccagtcagaatattggtatctggttggcctggtatcagcagaaaccagggaaagcccctaagctcctgatctataaggcctctactttacaaactggggtcctatcaacgttcagcggcagtagatctgggacagaattcactctcaccatcagcagcctgcagcctgatgattttgcaacttattactgcctaacagtaataataattatccgtggacgttcggaccaagggaccaaggtaggaaagtacaaaacgaactagtggcgtgcaccatctgtcttcta

SEQ ID NO: 788355 - DNA, 444 bp, Homo sapiens
  misc_feature: NA.51.52.E08.1.454.light.4.zerom50
agagagaaagggggtaggctcaggaggcagagctctgattgtctcaccatggcctggatccctctcctgctccccctcctcattctctgcacagtctctgtggcctcctatgagctgacacagccatactcagtgtcagtgtctccgggacagacagccaggatcacctgctcaggagatgtactgggaaaaaaatatgctcgttggttccagcagaaggcgggccaggcccctgtcttgatgatttataaagacactgagcggccctcagggatccctgagcgattctccggctccagctcagggactacagtcaccttgaccatcagcggggcccaggttgacgatgaggctgactattactgttactctgcggctgacaacaattctgggatattcggcggagggaccaagctgaccgtcttaggtcagcccaaggctccg

SEQ ID NO: 788356 - DNA, 457 bp, Homo sapiens
  misc_feature: NA.53.64.F09.1.454.light.4.zerom50
aggggtctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggcccccagactcctcattcatgacaataaccagcgagtcccagagattcctgaccgattctctggctccaagtctggcacctcagccaccctggccatcaccggactccagactggggacgaggccgattattactgcggaacatgggattccagcctgagtggtgtcgagggtgttcggcggagggaccaagctgaccgtcctaggtcagcccaac

SEQ ID NO: 788357 - DNA, 444 bp, Homo sapiens
  misc_feature: NA.43.68.G02.1.454.light.4.zerom50
agtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggcctacgggaccgacggthggagtgttcaagrcgaacgtgtggcgtgckaccatcttcg

SEQ ID NO: 788358 - DNA, 445 bp, Homo sapiens
  misc_feature: NA.40.31.C09.1.454.light.4.zerom50
aagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcta

SEQ ID NO: 788359 - DNA, 445 bp, Homo sapiens
  misc_feature: NA.3.42.D09.1.454.light.4.zerom50
agggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccaacagaaacctggccaggctcccaggctcctcattcatggtgcatctaacagggccgatggcattccagccaggttcagtggcagtggatatgggacagacttcactctcaccatcagcaatctgcagtctgaagattttgctagtttatttctgtcagcagtttaacacctggcctggaagttttggccaggggaccaagctggagctcaaacgaactgtggctgcaccat

SEQ ID NO: 788360 - DNA, 447 bp, Homo sapiens
  misc_feature: NA.7.31.C09.1.454.light.4.zerom50
tctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaagctgaccgtcctaggtcagcccaaggctgccccctcggt

SEQ ID NO: 788361 - DNA, 436 bp, Homo sapiens
  misc_feature: NA.41.81.H04.1.454.light.4.zerom50
caggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattacttgccgggcaagtcagggcattagaaatgatttagcctggtatcggcagaaaccaggaaaagcccctcagctcctcatctgtactgcatccactttacaaagtggggtcccatcaaggttcagcggcagtggatctggcacagatttcactctcaccatcagcagcctgcagcctgaagattttgcaacttattactgtctacaagattacaattaccctcggacttttggccaggggaccaggctggagatcaaacgaactgtggctgcacctacg

SEQ ID NO: 788362 - DNA, 444 bp, Homo sapiens
  misc_feature: NA.47.42.D09.1.454.light.4.zerom50
agggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggaccacgactggagattaaacgaactgtggctgcaccat

SEQ ID NO: 788363 - DNA, 415 bp, Homo sapiens
  misc_feature: NA.11.70.G04.1.454.light.4.zerom50
cagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaaggtggagataacg

SEQ ID NO: 788364 - DNA, 449 bp, Homo sapiens
  misc_feature: NA.14.8.A08.1.454.light.4.zerom50
agggaaccatggaaaccccagcgcagcttctcttcctcctgctactctggctcccagataccaccggagaaattgtgttggcgcagtctccaggcaccctgtctttgtctccaggggaaagagtcaccctctcctgtagggccagtcagagtgttaggagcacctacttagcctggtaccaccagaaacctggccaggctcccaggctcctcatctatggtacatccaccagggccactggcatcccagacaggttcagtggcagtgggtctgggacagacttcactctcaccatcagcagactggagcctgaagattttggagtgtattactgtcaccactatggtgaggcaccccccatcaccttcggccaagggacacgactggagattagacgaactgtggctgcaccatctgtcttcatcttcccgccatctgagtactagacg

SEQ ID NO: 788365 - DNA, 336 bp, Homo sapiens
  misc_feature: NA.9.11.A11.1.454.light.4.zerom50
gaaggggagagagccaccctctcttgcaggaccagtctgcatattcccagcacctacgtagcctggtaccagcagaaacctggccagtctcccaggctcctcatctatggtgcgtccaccagggccactggcatcccagaccgcttcagttccagtgggtctgggacagacttcactctcaccatccgcggactggagcctgaagattttgcagtttattactgtcagcagtatggtagctcaccgtacacttttggccaggggaccaagctggagatcaaacgaactgtggctgcaccatctgtcttcatcttcccgccatctgaagacgtatca

SEQ ID NO: 788366 - DNA, 435 bp, Homo sapiens
  misc_feature: NA.13.48.E04.1.454.light.4.zerom50
caggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccgaaggtaggaaatacaaacgaaactagtggcgtcg

SEQ ID NO: 788367 - DNA, 444 bp, Homo sapiens
  misc_feature: NA.13.46.E02.1.454.light.4.zerom50
ttgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaactgtggtcg

SEQ ID NO: 788368 - DNA, 455 bp, Homo sapiens
  misc_feature: NA.27.14.B03.1.454.light.4.zerom50
ttgrgtttcggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaaacgaactgtggctgcaccatctgtctt

SEQ ID NO: 788369 - DNA, 481 bp, Homo sapiens
  misc_feature: NA.27.59.F04.1.454.light.4.zerom50
tagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgttcccaccct

SEQ ID NO: 788370 - DNA, 434 bp, Homo sapiens
  misc_feature: NA.4.16.B05.1.454.light.4.zerom50
aggggatcaggactcctcagttcaccttctcacaatgaggctccctgctcagctcctggggctgctaatgctctgggtctctggatccagtggggatattgtgatgactcagtctccactctccctgtccgtcacccctggagagacggcctccatctcctgcaggtcgagtcagagcctcctgcacagtaatggatacaactatttggattggtacctgcagaagccagggcagtctccacagctcctgatctatttggtttctaatcgggcctccggggtccctgacaggttcagtggcagtggatcaggcacagattttacactgacaatcagcagagtggaggctgaggatgttggggtttattactgcatgcaagctctacaaactccggtcactttcggcggagggaccaaggtggagatcaaacgaa

SEQ ID NO: 788371 - DNA, 458 bp, Homo sapiens
  misc_feature: NA.5.73.G07.1.454.light.4.zerom50
aagggggaggaactgctcagttaggacccagacggaaccatggaagccccagcgcagcttctcttcctcctgctactctggctcccagataccactggagaaatagtgatgacgcagtctccagccgccctgtctgtgtctccaggggaaagagcctccctctcgtgcagggccagtcagagtgttagaatcaacttagcctggtaccagcagaaacctggccagcctcccaggcccctcatctatgctgcatccgccagggccactggtatcccagccaggttcagtggcagtgggtctgggacagacttcactctcaccatcagcagcctgcagtctgaagattttgcagtttattactgtcagcagtatgatgactggcctcagacgttcggccaagggaccaaggtggaagtcaaacgaactgtggctgcaccatctgtcttctaccttccccg

SEQ ID NO: 788372 - DNA, 332 bp, Homo sapiens
  misc_feature: NA.12.41.D08.1.454.light.4.zerom50
aaagagccaccctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcaccatcaccagactgcagtctgatgattttgcactttattactgtcagcactataataattggcctccggagtacacctttggccaggggaccaagctggagatcaaacgaactgtggctgcaccatctgtcttcatcttcccgccatctgatacgtcgtat

SEQ ID NO: 788373 - DNA, 467 bp, Homo sapiens
  misc_feature: NA.43.22.B11.1.454.light.4.zerom50
aggggtctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaataattttgtttcctggtaccagcaactcccaggaacagcccccaaactcctcatttatgacagtaataggcgaccctcagggattcctgaccgattctctggctccaagtctggcacgtcagccaccctgggcatcaccggactccagactggggacgaggccgattattactgcggaacatgggacagcagcctgaatacttgggtgttcggcggagggaccaggctgaccgtcctaagtcagcccaaggctgccccctcttc

SEQ ID NO: 788374 - DNA, 473 bp, Homo sapiens
  misc_feature: NA.4.21.B10.1.454.light.4.zerom50
agagagagagaggaggggggggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctcgccccctcggtcactctccgtt

SEQ ID NO: 788375 - DNA, 467 bp, Homo sapiens
  misc_feature: NA.8.2.A02.1.454.light.4.zerom50
agggggaggaactgctcagttaggacccagagggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcagcagcgtagcaactggcctttcactttcggcccggggaccaaagtggaaatcaaacgaactgtggctgcaccatctgtcttcatcttcccgccatactctacg

SEQ ID NO: 788376 - DNA, 461 bp, Homo sapiens
  misc_feature: NA.12.18.B07.1.454.light.4.zerom50
aagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagagcctgaagattttggaatttattactgtcaacagcgtagcaactggcctcccactttcggcggagggaccaaggtggagatcaagcgaactgtggctgcaccatctgtcttcatcttcccgcctac

SEQ ID NO: 788377 - DNA, 455 bp, Homo sapiens
  misc_feature: NA.16.75.G09.1.454.light.4.zerom50
aaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgtaggtcgttataactatgtctcctggtaccaacaacacccaggcaacgcccccaggctcatgatttatgaggtcaatgatcggccctcaggaatttccaatcgcttctctggctccaagtctggcaacacggcctccctgacaatctctgacctccagcctgaggacgaggctgaatattactgcagttcatatacaactaagagtcttgtggtattcggcggagggaccaagctgacagtcctaggtcagcccaaggctgccccctcc

SEQ ID NO: 788378 - DNA, 451 bp, Homo sapiens
  misc_feature: NA.12.27.C05.1.454.light.4.zerom50
agggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacggccaacatcacctgctctggagataaattggggcataaatatgtctgctggtatcaacagaaggcaggccagtcccctgtggttatcatctatcaagataacaagcggccctcagggatccctgagcgattctctggctccaactctgggaacacagccactctgaccatcagcgggacccaggctatggatgaggctgactattactgtcaggcgagggacagcagtactgcggtattcggcggagggaccaagctgaccgtcctaggtcagcccaaggctgccccctcggtcc

SEQ ID NO: 788379 - DNA, 469 bp, Homo sapiens
  misc_feature: NA.10.6.A06.1.454.light.4.zerom50
aacgacgacaaggggggggtctcaggaggcagcgctctcgggacgtctccaccatggcctgggctctgctattcctcaccctcctcactcaggggcacaggggtcctgggcccagtctgccctgactcagcctgcctccgtgtctgggtctcctggacagtcgatcaccatctcctgcactggaaccagcagtgacgttggtaggttataactatgtctcctggtaccaacaacacccaggcaaagcccccaaatcataattcatgatgtcaataatcggccctcaggggtttctaatcgcttctctggcttcaagtctggcaacacggcctccctgaccatctctgggctccaggctgaggacgaggctgattattactgcagctcatatacaaccagcagcactcggkkgttcggcggagggaccaagctcgaccgtcctaggtcagcccaaggcctcgtccccccg

SEQ ID NO: 788380 - DNA, 454 bp, Homo sapiens
  misc_feature: NA.5.3.A03.1.454.light.4.zerom50
gaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactgtggtattcggcggagggaccaagctgaccgtcctaggtcagcccaaggctgccccccg

SEQ ID NO: 788381 - DNA, 473 bp, Homo sapiens
  misc_feature: NA.40.18.B07.1.454.light.4.zerom50
agggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctgttcccccg

SEQ ID NO: 788382 - DNA, 471 bp, Homo sapiens
  misc_feature: NA.48.11.A11.1.454.light.4.zerom50
aaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccaccctcctt

SEQ ID NO: 788383 - DNA, 462 bp, Homo sapiens
  misc_feature: NA.53.12.B01.1.454.light.4.zerom50
tccgcggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcctgttctggaagcaggtccaacatcggaagtgattttgtattctggtaccagctgctcccaggagcgggccccaaactcctcatttacaggaatgatcagcggccctcaggggtccctgaccgattctctggctccaagtctggcacctcagcctccctggccatcagtggcctccggtccgacgatgaggctgattattattgtgcagcatgggatgacagcctgagtggtgtggtattcgggcggagggaccaagctgaccgtcctaggtcagcccaaggctccgg

SEQ ID NO: 788384 - DNA, 450 bp, Homo sapiens
  misc_feature: NA.4.4.A04.1.454.light.4.zerom50
aaggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgtcgggcaagtcagagtattaatagttggttggcctggtatcaccagagaccaggagaggccccaaggctccttatttatgatgcctccactgtgattagtggggtcccaccaacgttcagcggcagtggatctgggacatacttcactctcaccatcagcagcctgcagcctgatgatcttggaacttattactgccaacagtataatagtttttggacgttcggtccaggggaccgaaggtacgaaatagagacgaactagtggctgcaccatctgtcttcta

SEQ ID NO: 788385 - DNA, 460 bp, Homo sapiens
  misc_feature: NA.14.59.F04.1.454.light.4.zerom50
tagggattgggggatcaggactcctcagttcaccttctcacaatgaggctccctgctcagctcctggggctgctaatgctctgggtctctggatccagtggggatattgtgatgactcagtctccactttccctgaccgtcacccctggagagccggcctccatctcctgcaggtctagtcagagcctcctgcatactaatggaaacaactttttggattggtacctgcagaagccagggcagtctccacagctcctgatctatttgggttctaatcgggcctccggagtccctgacaggttcagtggcagtggatcaggcacagattttacactgaaaatcagcagagtggaggctgaggatgttggggtttattactgcatgcaagctctacaaactcgaacgttcggccaagggaccaaggtggaaatcaaacgaactgtggctgcaccatctgttt

SEQ ID NO: 788386 - DNA, 456 bp, Homo sapiens
  misc_feature: NA.43.48.E04.1.454.light.4.zerom50
ctgggcctcaggaagcagcatcgggggtgccgcagccatggcctggaccgctctccttctgagcctccttgctcactttacagagtctgtggcctcctacgagctgactcagccaccctcagtgtcagtggccctgggacaggcggccaggataacctgtgggggacacaatattgcagataagagtgtccactggtatcaccagaagcccggccaggcccctgtattggtcatctacagagacaccagccggcccgctgggatccctgagcgattctctgcctccaactcggggaacacggccaccctgaccatcagcagagcccaagtcggggatgagggtgactattactgtcaagtgtgggacaagagcactgtgattttcggcggaggggccaagttgaccgttttaggtcagcccaaggctgccccctcggtcactctcgttcccgccct

SEQ ID NO: 788387 - DNA, 458 bp, Homo sapiens
  misc_feature: NA.49.18.B07.1.454.light.4.zerom50
agggggaggagctgctcagttaggacccagagggaaccatggaagccccagctcagcttctcttcctcctgctactctggctcccagatatcaccggagaaattgtgttgacgcaatctccagccaccctgtctttgtctccaggggagagagcgaccctctcctgcagggccagtcagaatgttgacaactacttggcctggtaccagcagaagcctggccaggccccccggctcctcatctatgatgcttcaaacagggcccctgacaccccagccaggttcagtggcagtgggtctgggactggcttcactcttaccatcagcagtctcgagcctgaagatcttgctaatttatttctgtcaacagcgcagcaagtggcccctcacttttggccaggggaccaagttggagatcagacgaactgtggctgcaccatctgtcttcatccttccccg

SEQ ID NO: 788388 - DNA, 477 bp, Homo sapiens
  misc_feature: NA.26.61.F06.1.454.light.4.zerom50
cagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatcccggggtctctggccgattcagtgccagcgggtctgggaccagagttcactctcaccatcagcagcctgcaggctgaagatgtggcagtttattactgtcagcaattattttcgtgctccgtactacttttggccagggggacccgagggtggagatcagackractrktrrcwgcrmmawswgtmttywtsttammsgsstaaagtaagtagaagttaactacg

SEQ ID NO: 788389 - DNA, 464 bp, Homo sapiens
  misc_feature: NA.48.63.F08.1.454.light.4.zerom50
aaggggggagtcagacccagtcaggacacagcatggacatgagggtccccgctcagctcctggggctcctgctgctctggctcccaggtgccgagtgtgacatccagatgacccagtttccttccgccctgtctgcatctgtgggagacagagtcaccatcacttgtcgggccagtcagagtgttaataagtggttggcctggtatcagcagaaacccgggaaagcccctaacctcctaatctatgaggcatctactctacaaagtggagtcccatccaggttcagcggcagtgcatctgggaccgacttcagtctcaccatcagcagcctgcaccctgatgattttgcaacttattactgtcaacaatattatacttacccgtacacttttggccaggggactaagctggagatcaaacgaactgtggctgcaccatctgtcttcatcttccccgttcccccg

SEQ ID NO: 788390 - DNA, 440 bp, Homo sapiens
  misc_feature: NA.5.41.D08.1.454.light.4.zerom50
ctgatcaggactcctcagttcaccttctcacaatgaggctccctgctcagctcctggggctgctaatgctctgggtctctggatccagtggggagattgtgctgactcagtctccactctccctgtccgtcacccctggagagccggcctccatctcctgcaggtctagtcagagcctcctgcatagtaatggattcaactatttggattggtacctgcagaggccagggcagtctccacagctcctggtctatttgggctcttatcgggcctccggggtccctgagaggttcagtggcagtggatcaggcacagactttacactgcgaatcagcagagtggaggctgaggatgttggggtttattactgcatgcaagctctacaaaccctattcactttcggccctgggaccagagtggatatcaaacgaactgtggcg

SEQ ID NO: 788391 - DNA, 447 bp, Homo sapiens
  misc_feature: NA.10.52.E08.1.454.light.4.zerom50
agagagaaagggggagctgctcagttaggacccagagggaaccatggaaaccccagcgcagcttctcttcctcctgctactctggctcccaggtaccaccggagaaattgtgttgacacagtctccaggcaccctgtctttgtctccaggggaaagagccaccctctcctgcagggccagtcagagtgttaacaacaactacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcagcagtatggtgccccgcggctcagtttcggcggagggaccaaggttgagatcaaacgaactgtggctgcaccata

SEQ ID NO: 788392 - DNA, 458 bp, Homo sapiens
  misc_feature: NA.52.69.G03.1.454.light.4.zerom50
tcagaggccaaaggatgggagggggtcagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggaccagtgaggacatctacactagattagcctggtatcagcaagaaccggggagagcccctaaactcctgatccatactgcatccactttgcatgctggggtcccattcaggttcggcggcagtggatctgggacagaattcactctcacaatcagcagcctgcagactgaagactccgcaatttattactgtcaacaacgtcaccgttacccgatcaccttcggccaagggacacggctggagattaaacgaactgtggctgcaccatctgtt

SEQ ID NO: 788393 - DNA, 460 bp, Homo sapiens
  misc_feature: NA.2.81.H04.1.454.light.4.zerom50
ctggggtctcaggaggcagcgctctcaggacgtcaccaccatggcctgggctctgctcctcctcaccctcctcactcagggcacagggtcttgggcccagtctgccctgactcagcctccctccgcgtccgggtctcttggacagtcagtcaccatctcctgcactggaaccagcagtgacattggtgattatagacatgtctcctggtaccaacaggaaccaggcaaacgccccccgactcataatttatgaggtcaataagcggccctcaggggtccttgatcgcttctctggctccaagtctggcaacacggcctccctgaccgtctctgggctccaggctgacgatgaggctgattattactgcagctcagaagcaggcaccaacaattgggtgttcggcggagggaccaagctgaccgttcttaggtcagcccaaggctcgccccctcggtcact

SEQ ID NO: 788394 - DNA, 532 bp, Homo sapiens
  misc_feature: NA.43.40.D07.1.454.light.4.zerom50
taacaacagaggggagctgtgggctcagaagcagagttctggggtgtctccaccatggcctggacccctctctggctcactctcctcactctttgcataggttctgtagtttcttctgagctgactcaggaccctgctgtgtctgtggccttgtctgcgctgactcaggaccctgctgtatctgtggccttgggacagacagtcacgatcacatgccagggagacaacctcagaagtttttatgcaagctggtaccagcagaagccaggacaggcccctgtacttgtcatctttggtaaaaacaatcggccctcaggaatcccagaccgcttctctgcctccacctcaggagacactgcttccttgatcatctctggggctcaggcggacgatgaggctgactattattgtaattcccgggacaccagtggtaatacaaaagtggtttcggcrsagggaccaggctgaccgtcctgggtcagcccaaggctcgcccctcggtcactctgttcccacctcctcactactcaca

SEQ ID NO: 788395 - DNA, 482 bp, Homo sapiens
  misc_feature: NA.53.19.B08.1.454.light.4.zerom50
aggggctgggcctaaggaagcagcactggtggtgcctcagccatggcctggaccgttctcctcctcggcctcctctctcactgcacaggttctgtgaccccctatgtcctgactcagccaccctcggtgtcggtggccccaggacaggcggccaccattacctgtgggggagactacattggacgtaaaagtgtgcactggtaccagcaccagccaggccaggcccctatgatgctcctctatgacgatacccaccggccctcagggatccctgagcgattctctggctccaactctgagaacacggccaccctgaccatcagtggggtcgaggccggggatgaggccgtctattactgtcaggtgtgggatagtagtggtgatctgtgggtgttcggcggagggaccacgctgaccgtcctaggtcagcccaaggctgccccctcggtcactctcgttcccaccctcctctcgtactgccg

SEQ ID NO: 788396 - DNA, 443 bp, Homo sapiens
  misc_feature: NA.3.72.G06.1.454.light.4.zerom50
aggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccaaggtggagatcaaacgaactgtggctgcaccatctgttcrttcc

SEQ ID NO: 788397 - DNA, 463 bp, Homo sapiens
  misc_feature: NA.21.8.A08.1.454.light.4.zerom50
agggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagaatatacttgttggttccagcagaagtcaggccaggcccctgtactggtcatccatgaggccagtcgacgacactccgggatccctgagagattctctgcctccagctcagggacagtggccaccttgactatcagtggggcccaggtggacgatgaagctgactactattgttacgcaccagacagtagtggtcatcagggggtattcggcggagggaccaagttgaccgtccttggtcagcccaaggctgccccctcggtcactctccgcccc

SEQ ID NO: 788398 - DNA, 473 bp, Homo sapiens
  misc_feature: NA.9.65.F10.1.454.light.4.zerom50
aaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttctgactctgtctcctggtaccaacaacacccaggcaaaccccccaagctcatgatttatgatgtcaatcatcggccctcaggggtttctgatcgcttctctggctccaagtccggcaacacggcctccctgaccgtctctgggctccagactgacgacgaggctgattatttctgctcctcatatacaaggggcagcactctcgtactattcggcggagggaccaaggctgaccgtcctgggtcagcccaaggctgccccctcggtcacttcttcccg

SEQ ID NO: 788399 - DNA, 452 bp, Homo sapiens
  misc_feature: NA.10.70.G04.1.454.light.4.zerom50
acaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttatgatgtacactggtaccagcaacttcccggaacagcccccacgctcctcatctatggtgacaccaaccggccctcaggggtccctgagcgattctctgggtccaagtctggcacctcggcctccctggccatcactgggctccaggctgaggatgaggctgattattactgccagtcccatgacaacagcctgagtgtttgggtgttcggcggagggaccaagctgaccgtccttagtcagcccaaggctgccccctcggtcactctgttcccaccctcctccta

SEQ ID NO: 788400 - DNA, 424 bp, Homo sapiens
  misc_feature: NA.53.74.G08.1.454.light.4.zerom50
aggggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcaggtccaacatcggggcaggttatgatgtacactggtaccagcagcttccaggaacagcccccagactcctcatctatgctgacagcaatcggccctcaggggtccctgaccgattctctggctccaagtctggcacctcagcctccctggccatcactgggctccaggctgaggatgaggctgattattactgccagtcctatgacagcagcctgagagcgttattcggcggac

SEQ ID NO: 788401 - DNA, 447 bp, Homo sapiens
  misc_feature: NA.12.50.E06.1.454.light.4.zerom50
agaagagctgctcagttaggacccagagggaaccatggaaaccccagcgcagcttctcttcctcctgctactctggctcccagataccaccggagaaattgtgttgacgcagtctccaggcaccctgtctttgtctccgggggaaagagtcaccctctcctgcagggccagtcagagtgttagcggcaactacttagcctggtaccaacagaaacctggccaggctcccaggctcgtcatctatggtgcatccagcagggccactggcatcccagacaggttcagtggcagtgggtctgggacagacttcactctcaccatcagtagactggagcctgaagattttgcagtttattactgtcagcagtatgggggctcacgtcgattcactttcggccctgggaccaaagtagatgtcaaacgaactgtggctgcaccatctgtctt

SEQ ID NO: 788402 - DNA, 424 bp, Homo sapiens
  misc_feature: NA.51.48.E04.1.454.light.4.zerom50
ctgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgtcctgagtcagaccccg

SEQ ID NO: 788403 - DNA, 445 bp, Homo sapiens
  misc_feature: NA.51.44.D11.1.454.light.4.zerom50
agggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcaattgccgggcaagtcagagcattagcaggtatttaaattggtatcagcagaaaccagggaaagcccctaaggtcctgatctatgctgcatccagtttgcaaagtggggtcccatcaaggttcagtggcagtggatctgggacggatttcactctcaccatcagcagtctgcaacttgcagattctgcaacttactattgtcaacagagtttcaattcccctcgcacgttcggccaagggaccaaggtggaaatcaaacgaactgtggctgcaccatctgtcttcg

SEQ ID NO: 788404 - DNA, 444 bp, Homo sapiens
  misc_feature: NA.16.71.G05.1.454.light.4.zerom50
agagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctcccaggctcctcatctatggtgcatccagcagggccactggcatcccagacaggttcagtggcagtgggtctgggacagacttcactctcaccctcagcagactggagcctgaagattttgcagtgtattactgtcagcagtatggtagggcaccttacacttttggccaggggaccaagctggagatcaaacgaactgtggctgcaccatctgtcttcta

SEQ ID NO: 788405 - DNA, 453 bp, Homo sapiens
  misc_feature: NA.26.26.C04.1.454.light.4.zerom50
cctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatacaaacgaactagtggctgcaccattcg

SEQ ID NO: 788406 - DNA, 451 bp, Homo sapiens
  misc_feature: NA.10.4.A04.1.454.light.4.zerom50
aggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcggccctcaggggtccctgagcgaatctctggcgccaagtctgggaccacaggcacgctgaccatcagtgtgacccaggctgtggatgaggcagactattactgtcaggcgtgggacagtagcgctgtgattttcggcggagggaccaagctgaccgtcctaggtcagcccaaggctcgccccctcccccgttccc

SEQ ID NO: 788407 - DNA, 454 bp, Homo sapiens
  misc_feature: NA.26.77.G11.1.454.light.4.zerom50
aagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagacgaactgtggctgcaccatctgtcttcatcttcccg

SEQ ID NO: 788408 - DNA, 437 bp, Homo sapiens
  misc_feature: NA.17.26.C04.1.454.light.4.zerom50
agtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcaccatctcg

SEQ ID NO: 788409 - DNA, 453 bp, Homo sapiens
  misc_feature: NA.41.74.G08.1.454.light.4.zerom50
agggggagctacaacaggcaggcaggggcagcaagatggtgttgcagacccaggtcttcatttctctgttgctctggatctctggcgcctacggggacatcgtgatgacccagtctccagactccctggcagtgtctctgggcgggagggccaccatcaactgcaagtccagccagactattttatacggctcctacaataagaacgacttagcttggtaccagcagaaaccaggacagcctcctaagttgctcatttactgggcatctaaccgcatatccggtgtccctgaccgattcaatgccagcgggtctgggacagatttcactctcaccatcagcagcctgcaggctgaggatgtggcagtttattactgtcatcaatattatactactccgtggacgttcggccaagggaccaaggtggaattgaaacgaactgtggctgcaccta

SEQ ID NO: 788410 - DNA, 450 bp, Homo sapiens
  misc_feature: NA.5.1.A01.1.454.light.4.zerom50
agggggaagagctgctcagttaggacccagagggaaccatggaaaccccagcgcagcttctcttcctcctgctactctggctcccagaaagctccggagaaattgtgctgacgcagtctccaggcaccctgtctttgtctccagggcaaagagccaccctctcctgcagggccagtcagagtgttagcagcagttacttagcctggtaccagcagaatcctggccaggctcccaggctcctcatctattctacatccaccagggccactggcatcccaggcaggttcagtggcagtgggtctgggacagacttcactctcaccatcagcagactggagcctgaagattttgcagtgtattactgtcagcagtatggtagctcaccgtggacgttcggccgaagggaccgaaggtggaaatcgaacgaactagtggcgtgcaccatcttcg

SEQ ID NO: 788411 - DNA, 454 bp, Homo sapiens
  misc_feature: NA.21.26.C04.1.454.light.4.zerom50
agagaagagctgctcagttaggacccagagggaaccatggaaaccccagcgcagcttctcttcctcctgctactctggctcccagataccaccggagaaattgtgttgacgcagtctccggacaccctgtctttgtctccaggggaaagagccaccctctcctgcagggccagtcagattgttggcaacaactacttagcctggtaccagcagaaacctggccaggctcccaggctcctcatccatactgcctccaagagggccactggcatccctgacaggttcagtggcagtgggtctgggacagacttcactctcaccatcaccagactggagcctgatgattttgcagtttattactgccaccaacatgctttcgcaccgctcacgttcggcggagggaccagggtggagatcaaacgaactgtggctgcaccatctgtcttcattcccg

SEQ ID NO: 788412 - DNA, 448 bp, Homo sapiens
  misc_feature: NA.22.26.C04.1.454.light.4.zerom50
agtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcatcttccccg

SEQ ID NO: 788413 - DNA, 477 bp, Homo sapiens
  misc_feature: NA.10.80.H03.1.454.light.4.zerom50
aagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttcggcggagggaccaagctgaccgtcctaggtcagcccaaggctgccccctcggtcactctgttcccgacccc

SEQ ID NO: 788414 - DNA, 441 bp, Homo sapiens
  misc_feature: NA.5.70.G04.1.454.light.4.zerom50
caggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggcggagggaccaaggtggagatcaaacgaactgtggctgcaacmtctgtctt

SEQ ID NO: 788415 - DNA, 454 bp, Homo sapiens
  misc_feature: NA.26.57.F02.1.454.light.4.zerom50
ttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgctactttattactgtcagcagcgtagcaactcggcctctcwcgtttcggcgggasggaccggtagggtaggagatcgagacgtaact

SEQ ID NO: 788416 - DNA, 453 bp, Homo sapiens
  misc_feature: NA.53.55.E11.1.454.light.4.zerom50
ttgggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggaggataaatatacttgctggtatcagcagaagccaggccagtcccctgtgttggtcatctatcaagataggaagcggccctcagggatccctgagcgattctctggctccaactctgggaacacagccactctgaccatcagcgggacccaggctatggatgaggctgactattattgtcaggcgtgggacagcaaccctgattgggtgttcggcggagggaccaaactgaccgtcctaggtcagcccaaggctccgscccctcc

SEQ ID NO: 788417 - DNA, 448 bp, Homo sapiens
  misc_feature: NA.11.81.H04.1.454.light.4.zerom50
aggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagttttttactgtcagcagtatagtaactggcctccgtacacttttggccaggggaccaagctagaaatcaaacgaactgtggctgcaccatctgtcttctatt

SEQ ID NO: 788418 - DNA, 449 bp, Homo sapiens
  misc_feature: NA.9.28.C06.1.454.light.4.zerom50
aagcctgagaacacttagccttcatgagtgtccccaccatggcctggaggatgcttctcctcggactccttgcttatggatcaggagtggattctcagactgtggtgacccaggagccatcgttctcagtgtcccctggagggacagtcacactcacttgtggcttgagctctggctcagtctctactttttactaccccacctggtaccagcagaccccaggccaggctccacgtatgatcatctacagcacaaacactcgctcttctggggtccctgatcgcttctctggctccatccttgggaacaaagctgccctcaccatcacgggggcccaggcagatgatgaatctgattattactgtgttctatatatggatcgtggcatttggatgttcggcggagggaccaagttgaccgtcctaggtcagcccaaggcctgccccccg

SEQ ID NO: 788419 - DNA, 456 bp, Homo sapiens
  misc_feature: NA.9.3.A03.1.454.light.4.zerom50
agggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggctcccaggctcctcatttatgatgcatccaacagggccactggcgtcccagccaggttcagtggcagtgggtctgggacagacttcactctcaccatcagcagcctagagcctgaagattttgcattttattactgtcagcagcgtgccaagtggcttctcactttcggcggagggaccaaggtggagaccagacgaactgtggctgcaccatctgtcttcatcttccccg

SEQ ID NO: 788420 - DNA, 453 bp, Homo sapiens
  misc_feature: NA.4.45.E01.1.454.light.4.zerom50
tgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcaggccaggcccctgttctggtcatctgtggagacaccaaacgaccctccgggatccctgagagattctctggctccagctcagggacaatggccaccttgactatcagtggggcccaggtggaggatggaacctgactactattgttactcaacagacagcagtgctaatcatggggtgttcggcggtagggatcgaagctgaccgtcctaggtcagcccaaggctcgccccctcggtcactctcgttcccaccctcctcctac

SEQ ID NO: 788421 - DNA, 453 bp, Homo sapiens
  misc_feature: NA.48.65.F10.1.454.light.4.zerom50
aaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggacagtaagcggccctcaggggtttctaatcgcttctctggctccaagtctggcaacacggcctccctgacaatctctgggctccaggctgaggacgaggctgattattactgctgctcatatgcagatagtagcactcatgtggtattcggcggagggaccaagctgaccgtcctaggtcagcccaaggctccgs

SEQ ID NO: 788422 - DNA, 467 bp, Homo sapiens
  misc_feature: NA.3.34.D01.1.454.light.4.zerom50
ttggggtttggggggggagcttgggtttgggtgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccctgagcgaatctctggctccagctcagggacaacagtcacgttgaccatcagtggagtccaggcagaagacgaggctgactatcactgtcaaatagcagacagcaatggaacccatagggctgtggtgttcggcggagggaccaagctgaccgtcctaagtcacgcccaac

SEQ ID NO: 788423 - DNA, 425 bp, Homo sapiens
  misc_feature: NA.3.68.G02.1.454.light.4.zerom50
aagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagtgttagcagctatttaaattggtatcagcagaaaccagggaaagcccctaagctcctgatctatgctgcatccactttgcatggtggggtcccatcaagcttcagtggcagtggatctgggacagatttcactctcaccatcagcaatctgcaacctgaagattttgcaacttactactgtcaacagagttacagtacccctccgacttttggccaggggaccaagctggagatcaaacgaactagtggct

SEQ ID NO: 788424 - DNA, 462 bp, Homo sapiens
  misc_feature: NA.4.43.D10.1.454.light.4.zerom50
aggggggagtcagtctcagtcaggacacagcatggacatgagggtccccgctcagctcctggggctcctgctactctggctccgaggtggcagatgtgacatccagatgacccagtctccatcctccctgtctgcatctgtaggggacagcgtcaccatcacttgccggacaagtcagagcattaaccggtatttaaattggtatcagcaaaaaccaggggaagcccctaaactcctgatctatgctgcatccactttgcacagtggggtcccatcgaggttcagtggcagtggagctgggacagatttcactctcaccatcagcagtctgcaacctgaagattttgcaacttacttctgtcaacagagttacagttcccggacgttcggtccaacgggaccgaaacgtaggaaagtacatacgaactagtggcgtgcaccactctgtcttctacttccccg

SEQ ID NO: 788425 - DNA, 456 bp, Homo sapiens
  misc_feature: NA.22.46.E02.1.454.light.4.zerom50
tctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaagccccccaactcttaatttttggtgtcaataaccgcccctcaggggtccctgatcgcttctccggctccaagtctggcaacacggcctccctgaccatctctggactccaggctgacgatgagggtgacttttactgctgctcatatgcaggcaactataatatggtcttcggcggagggaccaaagtgaccgtcctaggtcagcccaaggctcgccccctcggtcactcccg

SEQ ID NO: 788426 - DNA, 381 bp, Homo sapiens
  misc_feature: NA.41.13.B02.1.454.light.4.zerom50
tccgcgggcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 788427 - DNA, 473 bp, Homo sapiens
  misc_feature: NA.53.66.F11.1.454.light.4.zerom50
aaggggctgggcctaaggaagcagcactggtggtgcctcagccatggcctggaccgttctcctcctcggcctcctctctcactgcacagtctctgtgacctcctatgtgctgactcagccaccctcggtgtcagtggccccaggaaagacggccgcgattacctgtgggggacacaacattggaactaaacgtgtgcactggtaccagcagatgcccggccaggcccctgttgtcgtctattatgatgtcgaccggccctcagggatccctgagcgattctctggctccacctctgggaacacggccaccctgaccatcagccgggtcgaggccggggatgaggccgactatttctgtcaaatctgggacagtaattttgacattccggtcttcggcggagggaccaagctgaccgtcctaggtcagcccaaggctgccccctcggtcactctgttcccaccctcctctcgta

SEQ ID NO: 788428 - DNA, 471 bp, Homo sapiens
  misc_feature: NA.41.4.A04.1.454.light.4.zerom50
aggggagagaagagctgctcagttaggacccagagggaaccatggaaaccccagcgcagcttctcttcctcctgctactctggctcccagaagccaccggagaagttgtgttgacgcagtctccggacaccctttctttgtctccaggacaaagagccaccctctcttgtagggccagtgagagtatttccggcaccttcttagcgtggtaccaacagcgacctggccaggctcccaggctcctcttctctgctgcgtatgccagggccgctggcatccctgacaggttcagtggcagtgggtctgggacagacttcactctcaccatcaatagactggagcctgaagattttgcaacatattactgtcaccagtttgcaatctcacccaggacgttcggccaacgggaccgaacggtaggaaatacaagacgaactgtggctgcaccatctgtcttcatcttcccgtcta

SEQ ID NO: 788429 - DNA, 442 bp, Homo sapiens
  misc_feature: NA.13.8.A08.1.454.light.4.zerom50
aggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccaggggaccaggctggagatcaaacgaactgtggctgcaccatctgtt

SEQ ID NO: 788430 - DNA, 462 bp, Homo sapiens
  misc_feature: NA.3.61.F06.1.454.light.4.zerom50
ctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggaagcgcccctcagggatccctgagcgcttttctggctccaagtctggggacacagccactctgactctcaccggggcccaggccatcgatgagggagactattactgtcaggcgtgggacagcacgactgcagtcttcggcggagggaccaagctgaccgtcctgggtcagcccaaggctgccccctcggtcactctgttcccaccctcctcggt

SEQ ID NO: 788431 - DNA, 319 bp, Homo sapiens
  misc_feature: NA.14.88.H11.1.454.light.4.zerom50
aacacacaaaggggacgttggtggttatgaccttgtctcctggtaccaacagcacccaggcaaagcccccaaactcataatttatgaggtcagtaggcggccgtcaggggtccctgatcgcttctctggctccaagtttggcaacacggcctccctgaccgtctctgggctccaggctgaggatgaggctgattattattgcatctcatatgcaggccctaatcattatggcctcggaactgggaccgaggtcaccgtcctgggtcagcccaaggccaaccccactgtcactctgttcccaccctcctcgtactagacg

SEQ ID NO: 788432 - DNA, 454 bp, Homo sapiens
  misc_feature: NA.12.19.B08.1.454.light.4.zerom50
aggggcctgaagacttttttatgggctggtcgcaccctgtgcaggagtcagtctcagtcaggacacagcatggacatgagggtccccgctcagctcctggggctcctgctactctggctccgagatgtgacatccagatgacccagtctccatcctccctgtctgcatctgtgggagacagagtcaccatcacttgccgggcaagtcagaggattagcagttatttaaattggtgtcagcagaagccagggagagcccctaaggtcctgatctatgcttcatccagtttgcaaagtggggtcccatcaaggttcagtggcagtggatctgggacagatttcactctcaccatcagcggtctgcaacctgaagattttgcaacttacttctgtcaacagagttacaatacccctccgtcacctgcggccaagggacacggctggagattaaaacg

SEQ ID NO: 788433 - DNA, 442 bp, Homo sapiens
  misc_feature: NA.8.5.A05.1.454.light.4.zerom50
aggggactgcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttggtacctacagggtatactggtaccaacagaagccagggagtcctccccagaatctcctggtatacaaatcagactcagataggcagcaggcctctggagtccccagccgcttctctggatccaaagatgcttcggccaatgcagggattttactcatctctgggctccagagtgacgatgaggctgactattactgtatgatttggcacaacagcgcttgggtgttcggcggagggaccaagctgaccctcctaggtcacg

SEQ ID NO: 788434 - DNA, 430 bp, Homo sapiens
  misc_feature: NA.7.81.H04.1.454.light.4.zerom50
agtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgaagtgcatatgaagagaactgtggctgcaccta

SEQ ID NO: 788435 - DNA, 453 bp, Homo sapiens
  misc_feature: NA.53.27.C05.1.454.light.4.zerom50
agggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggaggataaatatacttgctggtatcagcagaagccaggccagtcccctgtgttggtcatctatcaagataggaagcggccctcagggatccctgagcgattctctggctccaactctgggaacacagccactctgaccatcagcgggacccaggctatggatgaggctgactattattgttcaggcgtgggacagcaaccctgattgggtgttcggcggagggaccaaactgaccgtcctaggtcagcccaaggctgccccctcggt

SEQ ID NO: 788436 - DNA, 470 bp, Homo sapiens
  misc_feature: NA.41.29.C07.1.454.light.4.zerom50
agggaaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcagctctaacatcgggagtaatactgtaaactggtaccagcagctcccaggaacggcccccaaactcctcatctatgttaataataagcgaccctcaggggtccctgaccgattctctggctccaagtctggcacctcagcctccctggccatcagtgggctccagtctgaggatgaggctgattattactgtgcagcaccggatggcagcctgaatggttgggtgttcggcggagggaccaagctgaccgtcctaggtcagcccaaggctgccccccggt

SEQ ID NO: 788437 - DNA, 460 bp, Homo sapiens
  misc_feature: NA.14.64.F09.1.454.light.4.zerom50
agggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgataccccgtggacgttcggccaggggaccgaaggtggagatcaaacgaactagtggctgcaccatctgtcttcatcttcccgtccya

SEQ ID NO: 788438 - DNA, 447 bp, Homo sapiens
  misc_feature: NA.14.56.F01.1.454.light.4.zerom50
aacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtt

SEQ ID NO: 788439 - DNA, 444 bp, Homo sapiens
  misc_feature: NA.4.19.B08.1.454.light.4.zerom50
aggggggagtcagactcagtcaggacacagcatggacatgagggtccccgctcagctcctggggctcctgctgctctggctcccaggagccgattgtgacatccagttgacccagtctccctccaccctgtctgcatctataggagacagagtcaccatcacttgtcgggccagtcagaatatcaataggtggttggcctggtatctgcagagaccagggagagccccaaaactccttatctatgatgcctctactttgcacactggggtcccaccaacgttcagcggcagtggatccgggacagaattcactctcaccatcagcagcctgcagcctgatgatcttggaacttattactgccaacagtataatagttattggacgttcggccaggggaccaaggtggaattcaaacgaactgtggctgcaccatctgtcttcta

SEQ ID NO: 788440 - DNA, 442 bp, Homo sapiens
  misc_feature: NA.3.31.C09.1.454.light.4.zerom50
aggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgaactgtggctgcaccatctgtcttcta

SEQ ID NO: 788441 - DNA, 475 bp, Homo sapiens
  misc_feature: NA.52.10.A10.1.454.light.4.zerom50
agggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaaacctgcccaggctcccaggctcctcatctatgatgcatccaatcgggccactggcatcccagccaggttcagtggcagtgggtctgggacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgccatccygtwmccccactcttaccgt

SEQ ID NO: 788442 - DNA, 442 bp, Homo sapiens
  misc_feature: NA.3.2.A02.1.454.light.4.zerom50
agggggtaggggagtcagtctcagtcaggacacagcatggacatgagggtccccgctcagctcctggggctcctgctactctggctccgaggtgccagatgtgacatccagatgacccagtctccttcctccctgtctgcatctgtgggagacagagtcaccctcacttgccggccaagtcacagcattagcatctatttaaattggtatcaacagaagccagggaaagcccctaacctcctgatctatactgcatccagtttgcaaagtggagtcccatcaaggttcagtggcagtggatctgggacagagttcactctcaccatcagcagtctgcaacctgaagattttgcaacttactactgtcaacagagttacagtatccctccaaccttcggcggagggaccaaggtggagatcaaacgaactgtggctgcaccat

SEQ ID NO: 788443 - DNA, 461 bp, Homo sapiens
  misc_feature: NA.41.41.D08.1.454.light.4.zerom50
cttcagctgtgggtagagaagacaggactcaggacaatctccagcatggccagcttccctctcctcctcaccctcctcactcactgtgcagggtcctgggcccagtctgtgctgactcagtcaccctctgcgtctgggacccccgggcagagggtcaccatgtattgtgctgggagcaggtccaacatcggacgtaatactgtgagttggtatcagcaagtcccaggaacggcccccaaactcctcgtttctggaaacaatcagcggccctcaggagtccctgagcgattctctggctccaagtctggcacctcagcctccctggccatcagagggctccagtccgaggatgagggtgtttattattgtgcagtctgggatgacagtctgaatggtcattgggtgttcggcggagggaccaagttgaccgtcctaggtcagcccccaggctcgccccctcc

SEQ ID NO: 788444 - DNA, 485 bp, Homo sapiens
  misc_feature: NA.49.40.D07.1.454.light.4.zerom50
taacaacagaggggctgggcctcaggaagcagcatcggggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggatccctgagcgattctctggctccacgtcggggaacagggccactctgaccatcatcagggcccagggcgacgatgaggctgactattactgtcaggtcgaagacgccaaacttgtcatattcggcggagggaccaaattgaccgtcctgggtcagcccaaggctgccccctcggtcactctgttcccgccctcctctctctcgtact

SEQ ID NO: 788445 - DNA, 436 bp, Homo sapiens
  misc_feature: NA.41.61.F06.1.454.light.4.zerom50
aagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgactcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacagggtaacagtttccctctcactttcggcggagggaccaaggtggagatcaaacgaactgtggctgcaccatcttcg

SEQ ID NO: 788446 - DNA, 434 bp, Homo sapiens
  misc_feature: NA.12.51.E07.1.454.light.4.zerom50
caggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcaccta

SEQ ID NO: 788447 - DNA, 458 bp, Homo sapiens
  misc_feature: NA.40.3.A03.1.454.light.4.zerom50
aaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctmactttcggcggagggaccaaggtggagatcaaacgaactgtggctgcaccatctgtcttcatcttccccg

SEQ ID NO: 788448 - DNA, 452 bp, Homo sapiens
  misc_feature: NA.46.34.D01.1.454.light.4.zerom50
ttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcactgagttcacactgaaaatcagcagggtggaggctgaggatgttggaatttattactgcatgcaaggtgcacattggcctccggtcacttttggccaggggaccaagctggagatcaaacgaactgtgg

SEQ ID NO: 788449 - DNA, 460 bp, Homo sapiens
  misc_feature: NA.15.83.H06.1.454.light.4.zerom50
tcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgttcggccaagggaccgaacggtaggacgatacaaacgaactagtaggcgtgcaccactctgtcttt

SEQ ID NO: 788450 - DNA, 488 bp, Homo sapiens
  misc_feature: NA.52.7.A07.1.454.light.4.zerom50
aaggggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgcgccggaaccaacaatgatgttgggagttataaacttgtctcctggtaccaacaacaccccggcaaagcccccaaactcatcatttatgaggtcactaagcggccctcgggggtttctaatcgcttctctggctccaagtctggcgacacggcctccctgacaatctcttggctccaggctgaggacgaggctgattatttttgctgctcatatgcgggtagtagtaattatgtcttcggaagtgggaccacggtcaccgtcctgggtcagcccaaggccaaccccactgtcactctgttcccgccctcctctatacgtacg

SEQ ID NO: 788451 - DNA, 418 bp, Homo sapiens
  misc_feature: NA.49.32.C10.1.454.light.4.zerom50
cagtcccaaccaggacacagcatggacatgagggtccctgctcagctcctggggctcctgctgctctggctctcaggtgccagatgtatcatccagatgacccagtctccatcctccgtgtctgcatttataggagacagaatcaccatcacttgccgggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttctactttcaccatcagcagactgcagcctgaagatattgcaacatattactgtcaacagtatgataatcttccgctcactttcggcggagggaccaaggtggggatcagacgaactgtc

SEQ ID NO: 788452 - DNA, 457 bp, Homo sapiens
  misc_feature: NA.5.47.E03.1.454.light.4.zerom50
agagagaagggggaagagctgctcagttaggacccagagggaaccatggaaaccccagcgcagcatctcttcctcctgctactctggctcccagataccgccggagaaattgtgttgacgcagtctccaggcaccctgtctttgtctccaggagaaagagccaccctctcctgcagggccagtcagagtgttagcggcgactacttagcctggtaccagcagaaacctggccagactcccaggctcctcatctttggtgtatccagcagggccactggcatcccacgtaggttcagtggcagtgggtctgggacagacttcactctcaccatcagcagactggagcctgaagattttgcagtgtattactgtcagcagtatgggctctcacctttcactttcggcggagggaccaaggtggagaacaaacgaactgtggctgcaccatcttcgttcg

SEQ ID NO: 788453 - DNA, 436 bp, Homo sapiens
  misc_feature: NA.47.70.G04.1.454.light.4.zerom50
agtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgttt

SEQ ID NO: 788454 - DNA, 460 bp, Homo sapiens
  misc_feature: NA.43.52.E08.1.454.light.4.zerom50
ccgcggggcagcttcagctgtgggtagagaagacaggactcaggacaatctccagcatggccagcttccctctcctcctcgccctcctcactcactgtgcagggtcctgggcccagtctgtcctgactcagccaccctcagcgtctggggacccccgggcagagggtcaccatctcttgttctggaagcagctccaacatcggaagtaatactgtaaactggtaccagcagctcccaggaacggcccccaaactcctcatctacagtattaatcagcggccctcagggatccctgaccgattctctggctccaagtctggcgcctcagcctccctggccatcagtgggctccagtctgaggatgaggctgattattactgtgctgcagtgggatggacagcctgaatgcgttgggtggttcggcggagggaccaagctcgaccgtcctaggtcagacccg

SEQ ID NO: 788455 - DNA, 506 bp, Homo sapiens
  misc_feature: NA.51.49.E05.1.454.light.4.zerom50
aacacacaaagggcacgaccggtgctcgatttagagcgactagcaacacacaaagggggaggaactgctcagttaggagccagacggaaccatggaagccccagcgcagcttctcttcctcctgctactctggctcccagataccattggagagatagtgctgacgcagtctccagccaccctgtctgtgtctccaggggagagagtcaccctctcctgcagggcctctgagaatatagatatctacttggtctggtaccagcaaaaacctggccagcctcccaggctcctcgtccatagtgcctccgccagggccgctggtgtcccagccaggttccgaggcagtcggtctgggacagagttcactctcaccattaccaacctgcagtctgaagattttggactttattactgtcagcagtataatgactggcctaggacgttcggccaagggaccgagggtggaaatacaagacgaactgtggctgcaccatctgtcttctacg

SEQ ID NO: 788456 - DNA, 442 bp, Homo sapiens
  misc_feature: NA.16.70.G04.1.454.light.4.zerom50
aactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttatggtgcatccaccagggccactggtatcccagccaggttcagtggcagtgggtctgggacagagttcactctcaccatcagcagcctgcagtctgaagattttgcagtttattactgtcagcaatataatgactggcctccgctcactttcggcggagggaccaaggtggagatcaaacgaactgtggctgcaccatctgtcttcta

SEQ ID NO: 788457 - DNA, 454 bp, Homo sapiens
  misc_feature: NA.10.11.A11.1.454.light.4.zerom50
gaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggcccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaac

SEQ ID NO: 788458 - DNA, 468 bp, Homo sapiens
  misc_feature: NA.8.10.A10.1.454.light.4.zerom50
agggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacagacttcactctcaccatcagcagcctagagcctgaagattttgcactttattactgtcagcagcgtagtaactggcctttcactttcggccctgggaccaaagtggatatcaaacgaactgtggctgcaccatctgtcttcatcttcccgccatctgagacacgcg

SEQ ID NO: 788459 - DNA, 332 bp, Homo sapiens
  misc_feature: NA.4.30.C08.1.454.light.4.zerom50
aaggggaaagggccaccctctcctgcagggccagtcagagtgttagcaacagctacttagcctggtaccagcagaaacctggccaggctcccaggctcctcatctatggtgcatccaccagggccactggcatcccagacaggttcagtggcagtgggtctgggacagacttcactctcaccatcagcagactggagcctggagattttgcagtgtattactgtcagcagtatggtagttggaagacgttcggccaagggaccaaggtggaaatcaaacgaactgtggctgcaccatctgtcttcatcttcccgccatctgactacagtgct

SEQ ID NO: 788460 - DNA, 500 bp, Homo sapiens
  misc_feature: NA.21.81.H04.1.454.light.4.zerom50
tctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaaccccactgtctacgacccgaaccggaacccgaacccccaacccctacgttctaccttacccg

SEQ ID NO: 788461 - DNA, 427 bp, Homo sapiens
  misc_feature: NA.51.8.A08.1.454.light.4.zerom50
agggggkgcaggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatctaggttcagcggcagtggatctgggacagaattcactctcacaatcagcagcctgcagcctgaagattttgcaacttattactgtcaacagcacacttttggccaggggaccaagctggagatcaaacgaactgtggctgcaccat

SEQ ID NO: 788462 - DNA, 450 bp, Homo sapiens
  misc_feature: NA.17.36.D03.1.454.light.4.zerom50
atctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagagtgttagcagctacttagcctggtaccaacagaaacctggccagtctcccaggctcctcatctatgatgcatccaacagggccactggcatcccagccaggttcagtggcagtgggtctgggacagacttcattctcaccatcagcagcctagagcctgaagattttgcagtttattactgtcagcagcgtagcaactggctcatcaccttcggccaagggacacgactggagatgaaacgaactgtggctgcacctaccta

SEQ ID NO: 788463 - DNA, 440 bp, Homo sapiens
  misc_feature: NA.16.72.G06.1.454.light.4.zerom50
aggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtggagatcaaacgaactgtggctgcaccatcttcg

SEQ ID NO: 788464 - DNA, 453 bp, Homo sapiens
  misc_feature: NA.17.61.F06.1.454.light.4.zerom50
cttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaactcatgatttatgaggtcagtaatcggccctcaggggtttctaatcgcttctctggctccaagtctggcaacatggcctccctgaccatctctgggctccaggctgaggacgaggctgattattactgcagctcatatacaagcagcagcactccttgggtgttcggcggagggaccaagctgaccgtcctaggtcagcccaacg

SEQ ID NO: 788465 - DNA, 738 bp, Homo sapiens
  misc_feature: NA.3.74.G08.1.454.light.4.zerom50
agacgcactctcagatggcgggaagatgaagacagatggtgcagccacagttcgtttgactttccaccttggtcccttggccgaacgtccacggagaagaaacataatgttggcagtaataagttgcaaaatcatcaggctgcaggctgctgatggtgagagtaaactctgtcccagatccactgccgctgaaccttgatgggaccccaccctccaaattggaggcatcgtagatcaggaggttaggggctttccctggtctctgctgataccaggccaaaaagtgactaatactctgactggcccggcaagtgatggtgactctgtctccgacagatgcagacagggtggaaggagactgggtcatccagatgacccagtctccttccaccctgtctgcatctgtcggagacagagtcaccatcacttgccgggccagtcagagtattagtcactttttggcctggtatcagcagagaccagggaaagcccctaacctcctgatctacgatgcctccaawttggagggtggggtcccatcaaggttcagcggcagtggatctgggacagagtttactctcaccatcagcagcctgcagcctgatgattttgcaacttattactgccaacattatgtttcttctccgtggacgttcggccaagggaccaaggtggaaatcaaacgaactgtggctgcaccatctgtcttcatcttcccgccactctgagagtgcgtct

SEQ ID NO: 788466 - DNA, 456 bp, Homo sapiens
  misc_feature: NA.40.21.B10.1.454.light.4.zerom50
aaggggtgatcaggactcctcagttcaccttctcacaatgaggctccctgctcagctcctggggctgctaatgctctgggtcccagaattcagtggggatgttgtgatgactcagtctccactctccctgcccgtcacccttggacagccggcctccatctcctgcaggtctagtcaaagcctcactcgcagtgatggaagcacctacttgaattggtttcaccagaggccaggccaatctccgaggcgcctaatttgtgaggtttctaaccgcgactctggggtcccagacagattcagcggcagtgggtcaggcactgatttcacactgaaaatcagcagggtggaggctgaggatgttgggatttattactgcatgcaaggttcacactggcctccatacacttttggccaggggaccaagctggagatcaaacgaactacgtggcttgcacc

SEQ ID NO: 788467 - DNA, 443 bp, Homo sapiens
  misc_feature: NA.40.25.C03.1.454.light.4.zerom50
tgatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactagaaaatcagccgggtggaggctgaggatkggttggggtttattactgcatgmcaaggtttataccttcctcggactttcggccctggaccgagagtggagtgtaaaacgaactagttc

SEQ ID NO: 788468 - DNA, 458 bp, Homo sapiens
  misc_feature: NA.41.3.A03.1.454.light.4.zerom50
aggggagagctgctcagttaggacccagagggaaccatggaaaccccagcgcagcttctcttcctcctgctactctggctcccaggtgccaccggagaaattgtgttgacgcagtctccaggcaccctgtctttctctccaggggaaagagccaccctctcctgcagggccagtcagagtgttgacaaccagtacttcgcctggtaccagcagaaacctggccaggctcccaggctcctcatggatggtgcatccagcagggccactggcatcccagacaggttcggtggcagtgggtctgggacagacttcactctcaccatcagcagcctggagcctgaagattttgtagtgtattactgtcagcagtatcttacaacaccggggagttttggccaggggaccaagctggagatcaaacgaactgtggctgcaccatctgtcttcatcttccccgt

SEQ ID NO: 788469 - DNA, 482 bp, Homo sapiens
  misc_feature: NA.14.66.F11.1.454.light.4.zerom50
gggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaaacatccggccctcagggatcccagaccgattctctggctccaactcaggaaacacagcttccttgaccatcactggggctcaggcggaagatgaggctgactattactgtaattcccgggacagcagtgctaaccccaattatgtcttcggaactgggaccaaggtcaccgtcctaggtcagcccaaggccaaccccacctacg

SEQ ID NO: 788470 - DNA, 308 bp, Homo sapiens
  misc_feature: NA.19.31.C09.1.454.light.4.zerom50
cagcaagatggtgttgcagacccaggtcttcatttctctgttgctctggatctctggtgcctacggggacatcgtcatgacccagtctccagactccctggctgtgtctctgggcgagagggccaccatcaactgcaagtccagccagagtgttttatacagctccaacaataagaactacttaacttggtatcagcagaaaccaggacagcctcctaaggtgctcatttcctgggcatctacccgggaatccggggtccctgaccgattcagtggcagcgggtctgggacagatttcactctcagca

SEQ ID NO: 788471 - DNA, 456 bp, Homo sapiens
  misc_feature: NA.13.56.F01.1.454.light.4.zerom50
aacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctccgtacatgtacacttttggccaggggaccaacctggagatcagacgaactwc

SEQ ID NO: 788472 - DNA, 456 bp, Homo sapiens
  misc_feature: NA.43.54.E10.1.454.light.4.zerom50
aacacacaaagggggatcaggactcctcagttcaccttctcacaatgaggctccctgctcagctcctggggctgctaatgctctgggtcccaggatccattggggatattgtgctgactcagtctccactctccctctccgtcacccttggacagtcggtgtccatctcctgcaggtctagtcacagcgtcctacacagtgatggaagaacctacttggattggtttcagcagaggccaggccaatctccaaggctcctaatttataaggtttctagtcgggactctggggtcccagacagattcagcggcagtgggtcaggcactgacttcacactgaaaatcagtagtgtggaggctgaggatgttgccatttattactgcatgcaagggacacactggccgtacacttttggccaggggaccaagctggagatcaaacgaactgtggctccgg

SEQ ID NO: 788473 - DNA, 430 bp, Homo sapiens
  misc_feature: NA.51.51.E07.1.454.light.4.zerom50
aggagtcagtcccaaccaggacacagcatggacatgagggtccctgctcagctcctggggctcctgctgctctggctctcaggtgccagatgtgacatccagatgacccagtctccatcctccctgtctgcatctgtaggagacagaatcaccttcacttgccgggcgagtcaggacattagcaactatttaaattggtatcagcagaaaccagggaaagcccctaaactcctgatctacgatgcatccaatttggagacaggggtcccatcaaggttcagtggaagtggatctgggacactattttactttcaccatcagcggcctgcagcctgaagattttgcaacatattactgtcaacagtatgaggatctcccactcactttcggcggagggaccaaggtggagatcagacgaactgtggctgca

SEQ ID NO: 788474 - DNA, 458 bp, Homo sapiens
  misc_feature: NA.16.6.A06.1.454.light.4.zerom50
agggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggagatcaaacgaactgtggctgcaccatcttcg

SEQ ID NO: 788475 - DNA, 444 bp, Homo sapiens
  misc_feature: NA.4.68.G02.1.454.light.4.zerom50
tctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacattggtggttataactatgtctcctggtaccagcaacacccaggcaaagcccccaaactcatcgtttatgatgtcactgatcggccctcaggggtttctagtcgcttctctggctccaagtctggcaacacggcctccctgaccatctctgggctccaggctgaggacgaggctgattattactgcagctcatatacaagcagcagcactcgtgggggtattcgggcggagggaccaagctgaccgtcctaggtcagcccaaggctccg

SEQ ID NO: 788476 - DNA, 453 bp, Homo sapiens
  misc_feature: NA.41.10.A10.1.454.light.4.zerom50
agggggcatgagcaagactgacaagtcaaggcaggaagatgttgccatcacaactcattgggtttctgctgctctgggttccagcctccaggggtgaaattgtgctgactcagtctccaggctttcagtctgtgactccaaaggagaaagtcaccatcacctgccgggccagtcagagcattgatagtgatttacactggtaccagcagaaaccaaatcagtctccaaagctcctcatcaagtattcttcccagtccatctcaggggtcccctcgaggttcagtggcagtggatctgggacagatttcaccctcaccatcagtagcctggaagctgaagatgctgcaacgtattactgtcatcagagtcgtagtttacctcaaacgttcggccaagggaccaaggtggaaatcaaacgaactgtggctgcaccatctgtcttcatcttccccg

SEQ ID NO: 788477 - DNA, 443 bp, Homo sapiens
  misc_feature: NA.14.68.G02.1.454.light.4.zerom50
caggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacatcaggaaatatttaaattggtatcagcagaaaccagggaaagcccctaaactcctgatcttcgatgcatccaatttggaaacaggggtcccatcaaggttcaggggaagtggatctgggacagattttagtttcaccatcagcagcctgcagcctgaagatattggaacatattactgtcaacagtatgataatttaccgctcactttcggcggagggaccaaggtggacatcaaacgaactgtggctgcaccatcttcgttcg

SEQ ID NO: 788478 - DNA, 348 bp, Homo sapiens
  misc_feature: NA.12.6.A06.1.454.light.4.zerom50
agggccagtcagagtcttagtagaggtcagatctttaccagggccagtccgactggtagcagcagcaacctagcctggtaccagcagagacctggccaggctcccaggctcctcatctatggcgcatccaaaagggccactggcatcccagacaggttcagtggctctggctctgggactgacttcactctcatcatcgacagactggagcctgaagattttgcagtctattactgtcaacagtatggtagcccacctaacacttttggcccggggaccaagctggagatcagacgaactgtggctgcaccatctgtcttcatcttcccgccatctgatacgtcgtat

SEQ ID NO: 788479 - DNA, 460 bp, Homo sapiens
  misc_feature: NA.29.67.G01.1.454.light.4.zerom50
ttgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctc

SEQ ID NO: 788480 - DNA, 470 bp, Homo sapiens
  misc_feature: NA.14.70.G04.1.454.light.4.zerom50
agggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactcttccgtt

SEQ ID NO: 788481 - DNA, 462 bp, Homo sapiens
  misc_feature: NA.21.15.B04.1.454.light.4.zerom50
tccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatcctcctccgacaataagaactacttagcttggtaccagcagcaaccaggacaacgtcctaaattgctcatttactgggcatctgtccgggaatccggggtccctgaccgattcgttggcagcgggtctgggacagatttcactctcaccatcagcagcctacaggctgaagatgtggcagtttatttttgtatgcaacattatgccgctccgctcactttcggcggagggaccaaggtggagatcaaacgaactgtggctgcaccatcttcg

SEQ ID NO: 788482 - DNA, 261 bp, Homo sapiens
  misc_feature: NA.21.86.H09.1.454.light.4.zerom50
ttgggtttggggggtgtggtggtctccactcccgctttgacggggctgctatctgcccgattctctggctccaagtctggcacctcagccaccctggtcatcagcgaactccagtccggggacgaggccatttattactgcggaacgtgggacagttccctgactgtcggggtgttcggcggagggaccacagtgaccgtcctaggtcagcccaaggctgccccctcggtcactctgttcccaccctcctccgagcgacga

SEQ ID NO: 788483 - DNA, 454 bp, Homo sapiens
  misc_feature: NA.19.72.G06.1.454.light.4.zerom50
tcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtgtgcggcggagggaccaaggtgaccgtcctgggtcagcccaaggctgccccctcggtcactccg

SEQ ID NO: 788484 - DNA, 448 bp, Homo sapiens
  misc_feature: NA.11.71.G05.1.454.light.4.zerom50
aggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcattcttccccg

SEQ ID NO: 788485 - DNA, 454 bp, Homo sapiens
  misc_feature: NA.5.68.G02.1.454.light.4.zerom50
caggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagatttttataagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcagcccaaggctgccccctcggtcactctgttcccaccctcctccgtgt

SEQ ID NO: 788486 - DNA, 455 bp, Homo sapiens
  misc_feature: NA.19.15.B04.1.454.light.4.zerom50
tccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaagggaccaaggtagaaatgaaacgaactgtggctgcaccatctycscg

SEQ ID NO: 788487 - DNA, 474 bp, Homo sapiens
  misc_feature: NA.41.56.F01.1.454.light.4.zerom50
aacacacaaaggggggggtcacaagaggcagcgctctcgggacgtctccaccatggcctgggctctgctgctcctcactctcctcactcaggacacagggtcctgggcccagtctgccctgactcagcctgactccgtgtctgggtctcctggacagtcgatcaccatctcctgcactggaaccaacagtgatgttgggaattataaccttgtctcctggtaccaacaccacccaggcaaagcccccaaactcataatttatgagggcagtaagcggccctcaggggtttctaatcgcttctctggctccaagtctggcaacacggcctccctgacaatctctggactccaggctgaggacgaggctgattattactgctgctcatatgcaggtagtagggatctgggtgttcggcggagggaccaagctgaccgtcctgggtcagcccaaggctccgccccctcggtctaccg

SEQ ID NO: 788488 - DNA, 450 bp, Homo sapiens
  misc_feature: NA.3.29.C07.1.454.light.4.zerom50
agggaaagggggcaggagtcagtcccaaccaggacacagcatggacatgagggtccctgctcagctcctggggctcctgctgctctggctctcaggtgccagatgtgacatgcagatgacccagtctccctcctccctgtctgcatctgtgggagacagcgtcaccatcacttgccaggcgagtcaggacattagcacctatttaaattggtatcaacagaagccagggaaagcccctaaagtcctaatatatgatgcatccaagttgcaaacaggggtcccatccaggttcaggggaggtggatctgggacacactttactctcaccatcagcagcctgcagcctgaagattttgcaacatatttttgtcaacattatgacaatcgtccccccgtacwacttttgggccaggggaccaaggtggagatcaaacgaactgtggctgcacc

SEQ ID NO: 788489 - DNA, 455 bp, Homo sapiens
  misc_feature: NA.40.45.E01.1.454.light.4.zerom50
aggaactgctcagttaggacccagagggaaccatggaagccccagctcagcttctcttcctcctgctactctggctcccagtaatcaccggagaaattgtgttgacacagtctccagccaccctgtccttctctccaggggaaagagcctccctctcctgcagggccagtcagagtattaataccttcttggcctggtaccagcaaaagcctggccaggctcccagactcctcatctatgatgcatccaacagggccactggcgtcccggccaggttcagtggcagtgggtctgggacagacttcactctcaccatcagcagcctagagcctgaagattttgcagtttattactgtcagcagcgtgccaactggcctctcactttcggcggagggaccaaggtggagatcaaacgaactgtggctgcaccatctgtcttcatcttcccgcctatg

SEQ ID NO: 788490 - DNA, 474 bp, Homo sapiens
  misc_feature: NA.53.13.B02.1.454.light.4.zerom50
tccgcggggccgggcctaaggaagcagcactggtggtgcctcagccatggcctggaccgttctcctcctcggcctcctctctcgctgcacagactctgtgacctcctatgagctgactcagccaccctcggtgtctgtggcccctggacagacggccaccctgacttgtgggggagacaacattgcaattaaagctgtgcactggtaccaacagaggccaggccaggcccctctattggtcctctatgatgatgatgatcggccctccgggatccctgagcgattttctggctccaactctgcgaccacggccaccctgatcatctccggggtcgaggtcgacgatgaggccgactatttctgtcaggtgtgggacattgacagtgattgggtgtttggcgggggaaccaagctgaccgtcctcggtcagccaaggctgccccctcggtcactctgttcccgccctcctctccg

SEQ ID NO: 788491 - DNA, 442 bp, Homo sapiens
  misc_feature: NA.40.69.G03.1.454.light.4.zerom50
aggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgcagtttattcctgtcagcagtacaatgactggccgtacacttttggccaggggaccaagctggagatcaaacgaactgtggctgcaccattcgtcttcta

SEQ ID NO: 788492 - DNA, 434 bp, Homo sapiens
  misc_feature: NA.26.70.G04.1.454.light.4.zerom50
caggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccgggggacacggctggaaactaaacgaactgtggctgcaccta

SEQ ID NO: 788493 - DNA, 470 bp, Homo sapiens
  misc_feature: NA.9.52.E08.1.454.light.4.zerom50
agagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaagagccaccctctcctgcagggccagtcagagtgttggtacgtccttactctggtaccaacaaaaacctggccaggctcccaggctcctcatctatgatgcatccaccagggccactggcatccccgccagattcagtggcagtgggtctgggacagacttcactctcaccatcagcagcctggaccctgaagattttgcagtttattactgtcagcagcggaccaattggcccctctccctcactttcggcgggggaccgaaggtggagctcaaacgaactgtggctgcaccatctgtcttcatcttcccgt

SEQ ID NO: 788494 - DNA, 472 bp, Homo sapiens
  misc_feature: NA.51.17.B06.1.454.light.4.zerom50
agggggtggtgggaggcagttgagccctggattgtgactgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaaggcggggacccagaccctggacgcctcagttggaagcagccgatccagcctgcggagtcccg

SEQ ID NO: 788495 - DNA, 445 bp, Homo sapiens
  misc_feature: NA.13.15.B04.1.454.light.4.zerom50
tccgcgggggtgcatgtcaggctgtgtccaccatggcctggactcctcttcttctcttgctcctctctcactgcacaggttccctctcccagcctgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgaggatgaggctgactattactgtatgatttggccaagcaatgatgtggtattcggcggagggaccaagctgaccgtcctaggtcagacccg

SEQ ID NO: 788496 - DNA, 474 bp, Homo sapiens
  misc_feature: NA.4.78.H01.1.454.light.4.zerom50
tgatcaggactcctcagttcaccttctcacaatgaggctccctgctcagctcctggggctgctaatgctctgggtcccaggatccagtggggatgtcttttattcaggatccagtggggatgttgtgttgactcagtctccactctccctgcccgtcacccttggacagccggcctccatctcctgcaggtctagtcaaagcctcgaacacagtaccggaaacaccttcttgagttggtatcaccagaggccaggccaatctccaaggcgcctactttataaggtttctaaccgggactctggggtcccagacagattcagcggcagtgggtcaggcactgatttcacactgagaatcagcagggtggaaactgaggatgttgggatttattactgcttgcaaggttcacactggccttggacgttcggcccgagggaccgaaggtaggaaatacaaacgaactagtggctggm

SEQ ID NO: 788497 - DNA, 452 bp, Homo sapiens
  misc_feature: NA.12.82.H05.1.454.light.4.zerom50
agagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgaagattttgcagtgtattattgtcagcagtatggtagcgcaccgtacacttttggccaggggtccaagctggagatgaaacgaactgtggctgcaccatctgtcttcatcttccccg

SEQ ID NO: 788498 - DNA, 454 bp, Homo sapiens
  misc_feature: NA.17.40.D07.1.454.light.4.zerom50
taacaacagagggggtggtagctcaggaagcagagcctggagcatctccactatggcctgggctccactacttctcaccctcctcgctcactgcacaggttcttgggccaactttatgctgactcagcccctctctgtgtcggggtctccggggaagacaataaccatctcctgcacccgcagcagtggcaacattggcagccaatatgtgcagtggtaccagcagcgcccgggcagttcccctagaactgtgatctatgaagatactgtcagaccctccgggatccctgatcggttctctggctccgtcgacagttcctccaactctgcctccctcaccatctctggactgacgactgaggacgagggtgactactactgtcactcttatgatgacatttatgaggcgatattcggcggagggacaaaggtgaccgtgctaggtcagaccccg

SEQ ID NO: 788499 - DNA, 463 bp, Homo sapiens
  misc_feature: NA.10.44.D11.1.454.light.4.zerom50
arggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccgaaagtggatatcaaacgaactagtggctgcaccatctgtcttcatt

SEQ ID NO: 788500 - DNA, 504 bp, Homo sapiens
  misc_feature: NA.15.78.H01.1.454.light.4.zerom50
tacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttagcccccgtttcactcttcccgccatctgagctacgtagacg

SEQ ID NO: 788501 - DNA, 403 bp, Homo sapiens
  misc_feature: NA.10.76.G10.1.454.light.4.zerom50
agggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctccactactatg

SEQ ID NO: 788502 - DNA, 333 bp, Homo sapiens
  misc_feature: NA.19.60.F05.1.454.light.4.zerom50
ggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgacacgagagta

SEQ ID NO: 788503 - DNA, 508 bp, Homo sapiens
  misc_feature: NA.3.27.C05.1.454.light.4.zerom50
agggtttgggcacgaccggtgctcgatttagacgcgatcgaaagggtttgggggagctacaacaggcaggcaggggcagcaagatggtgttgcagacccaggtcttcatttctctgttgctctggatctctggtgcctacggggacatcgtgatgacccagtccccagactccctggctgtgtctctgggcgagagggccaccatcaactgcaagtccagccagagtgttttatacagctccgacaataagaactacttagcttggtaccagcagaaaccaggacagcctcctaaactgctcatttactgggcatctacccgggaatccggggcccctgaccgattcaatggcagcgggtctggggcagatttcactctcaccatcagcagcctgcaggctgaagatgtggcagtttattactgtcagcaatattatactcctcttccgacgttcggccaagggaccaaggtggaaatcaaacgaactgtggctgcaccatctgtctt

SEQ ID NO: 788504 - DNA, 459 bp, Homo sapiens
  misc_feature: NA.10.64.F09.1.454.light.4.zerom50
agggggaggaactgctcagtcaggacccagagggaaccatggaagccccagctcagcgtctcttcctcctgctactctggctcccagatataaccgccggagaaattgtgttgacacagtctccagccaccctgtctttgtctccaggggaaagagccaccctctcctgcagggccagtcagagtgttagcactaacttagtctggtaccaacagaaacctggccaggctcccaggctcctcatctatgatgcatccacgagggccactggcatcccagccaggttcagtggcagtgggtctgggacagacttcactctcaccatcaccggcctagaccctgaagattttgcagtttattactgtcagcagcgtagcagctggcccctctccctcactttcggcggagggaccaaggtggagatcaaacgaactgtggctgcaccatctgtcttctatt

SEQ ID NO: 788505 - DNA, 439 bp, Homo sapiens
  misc_feature: NA.19.28.C06.1.454.light.4.zerom50
agagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccaagggggacgggatccctgatcgtttttcagggtccagctctggggctgagcgctacctcaccatctccagcctccagtctgaggatgaggctgactattactgtcagacctggggcactggttatgtggttttcggcggagggaccaagctgaccgtcctaggtcagcccaaggctgtccccccg

SEQ ID NO: 788506 - DNA, 449 bp, Homo sapiens
  misc_feature: NA.41.70.G04.1.454.light.4.zerom50
tgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctcgcccctcggtcactctccg

SEQ ID NO: 788507 - DNA, 446 bp, Homo sapiens
  misc_feature: NA.9.64.F09.1.454.light.4.zerom50
aggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggtccactcagagtatgagtacttggttggcctggtatcagcagaaaccagggaaagcccctaaactcctaatctatgatgcctccattttggaaagtggggtcccatcaaggttcagcggcagtggatctgggacagaattcactctcaccatcagcagcctgcagcctgatgattttgcaacttattactgccaacgccataactggtatttcggccctgggaccaaagtggatgtcaaacgaactgtggctgcaccatctgtcttcatcttccccg

SEQ ID NO: 788508 - DNA, 452 bp, Homo sapiens
  misc_feature: NA.4.40.D07.1.454.light.4.zerom50
taacaacagagggggagctgctcagttaggacccagaggcaaccatggaaaccccagcgcagcttctcttcctcctgctactctggctcccagataccacaggagaagttgtgttgacgcagtctccaggcaccctgtctttgtctccaggggagagggccaccctctcctgcaggaccagtcagagtgataccaacaactttttagcctggtaccaacagaaagctggccaggctcccaggctcctcatctatggtgcatccatcagggccactggcatcccagacaggttcagtggcagtgggtctgggacagacttcactctcatcatcaacagactggagcctgaggattctgcagtgtattactgtcaccagtatggtggggcgcgcgttttcggcgggggaccgaaggtggacatcaaacgaactgtggctgcaccatctgttctt

SEQ ID NO: 788509 - DNA, 448 bp, Homo sapiens
  misc_feature: NA.4.8.A08.1.454.light.4.zerom50
aaggggctgggcctcaggaagcagcatcggaggtgcctcagccatggcatggatccctctcttcctcggcgtccttgcttactgcacaggatccgtgccctcctatgaactgactcagccaccgtcagtgtccgtgtccccaggacagacagccagcattagttgctctggagatagattggagaataaatttgttacctggtatcagcagaagccaggccagtcccctgtgctggtcatctatcaggataaggagcggccctcagggatccctgagcgaatctctggctccaactctgggaacacagccactctgaccatcagcgggacccaggctatggatgagggtgactattactgtcaggcgtgggacagcccttatgtggtattcggcggagggaccaagctgaccgtcctaggtcagcccaaggctgccccctcggtcmck

SEQ ID NO: 788510 - DNA, 493 bp, Homo sapiens
  misc_feature: NA.2.1.A01.1.454.light.4.zerom50
agggggctggggtctcaggaggcagcgctctcgggacgtctccaccakggcctgggctctgctattcctcaccctcctcactcagggcacagggtcctgggcccagtctgccctgactcagcctgcctccgtgtctgggtctcctagacagacgctcaacatttcctgcactggaaccagcagtgacgttggtggttatgattctgtctcctggtaccaacaacacccggccagagcccccaaactcttaatttatgatgtcagaaatcggccctcaggggcttctactcgcttctctggctccaagtctggcaacacggcctccctgaccatctcttgggtccaggctgaggacgaggctatatattattgcagttcatatacaagcagtagcacggtggtcttcggcggagggaccaagctgaccgtcctaggtcagcccaaggctcgccccctcggtcactcttcgttcccrccctcctctgtcgagcgt

SEQ ID NO: 788511 - DNA, 474 bp, Homo sapiens
  misc_feature: NA.9.16.B05.1.454.light.4.zerom50
aggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcgctggagccaccaatgactttggtggttttaattctgtgtcctggtaccaaaaacacccaagcaaagcccccaaactcctcatttatcagtccactaagcggccctcaggggtccctggtcgcttctctggctctaagtctgacgacacggcctccctgaccgtctctgggctccaggctgaggatgaggctgattattactgcacctcatatgcaggctacggcagtcatgtgatattcggcggagggaccaagctgaccgtcctaagtcagcccaaggctgccccctcggtcactctcgttcccga

SEQ ID NO: 788512 - DNA, 453 bp, Homo sapiens
  misc_feature: NA.43.25.C03.1.454.light.4.zerom50
actgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttggggtttattactgcatgcaaggtacacactggcccgtcaccttcggccaagggacacgactggagattaaacgaactgtggctgcaccatctgtt

SEQ ID NO: 788513 - DNA, 460 bp, Homo sapiens
  misc_feature: NA.3.21.B10.1.454.light.4.zerom50
agagrrgagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtccactctcgtt

SEQ ID NO: 788514 - DNA, 444 bp, Homo sapiens
  misc_feature: NA.7.76.G10.1.454.light.4.zerom50
gagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaaggtggagatcaaacgaactgtggctgcaccaatcg

SEQ ID NO: 788515 - DNA, 477 bp, Homo sapiens
  misc_feature: NA.52.16.B05.1.454.light.4.zerom50
aggggctgggcctaaggaagcagcactggtggtgcctcagccatggcctggaccgttctcctcctcggcctcctctctcactgcacagactatgtgacttcctatgtgctgactcagccaccctcggcgtcagtggccccaggacagacggccacgattacctgtgagggaaactacattgaaaggaaaagtgtccattggtatcagcagaagccaggccaggcccctgtgctggtcctccatgatgatagcgaccggccctcagggatccctgagggattctccggctccaactctgggaacacggccaccctgaccatcagcagggtcgaagccggagatgaggccgactattactgtcaggtgtgggatcgtgatagtgaccattgggtgttcggcggagggaccaagttgaccgtcctaagtcagcccaaggctcgccccctcggtcactctgttcccgccctcctctacacg

SEQ ID NO: 788516 - DNA, 463 bp, Homo sapiens
  misc_feature: NA.21.39.D06.1.454.light.4.zerom50
cagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcagaaaccagggaaagcccctaaactcctgatctatgctgcatccagtttggaaagtggggtcccatcaaggttcagcggcagtggatctgggacagatttcactctcaccatcagcagcctgcagcctgaagattttgcaacttattattgttcaacaggctcacggtttcccccggactttcgkcggacgggaccgaacggtaggaggagtactaaacgaaactacgtggckygtcacctaa

SEQ ID NO: 788517 - DNA, 421 bp, Homo sapiens
  misc_feature: NA.49.2.A02.1.454.light.4.zerom50
agrgggrgtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaa

SEQ ID NO: 788518 - DNA, 459 bp, Homo sapiens
  misc_feature: NA.21.33.C11.1.454.light.4.zerom50
ttgggtttggggggagaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatattctacagggccgcgggcatcccagacaggttcagtggcagtgggtctgggacagacttcactctcaccatcagcagactggagcctgaagattttgcaatgtattactgtcagcaatatgctcmacccccgatcaccttcggccaagggacacgactgcagatagaaacgaactgtggctgcaccatctgtctt

SEQ ID NO: 788519 - DNA, 513 bp, Homo sapiens
  misc_feature: NA.15.33.C11.1.454.light.4.zerom50
ttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttagcccccgtttcatcttcccgccatctgagctacgtacg

SEQ ID NO: 788520 - DNA, 473 bp, Homo sapiens
  misc_feature: NA.40.43.D10.1.454.light.4.zerom50
agggggaggaactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgcactttattactgtcaccagcgtagcagctggcctcgaacgttcggccaagggaccaaggtggacgatcaagcgaactgtggctgcaccatctgtcttcatcttcccgccactcctgaagtcgct

SEQ ID NO: 788521 - DNA, 453 bp, Homo sapiens
  misc_feature: NA.8.71.G05.1.454.light.4.zerom50
aagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccatt

SEQ ID NO: 788522 - DNA, 448 bp, Homo sapiens
  misc_feature: NA.11.25.C03.1.454.light.4.zerom50
ctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacgcagccactctgaccatcagcgggacccaggctatggatgaggctgactattattgtcaggcgtgggacagcagcactgcccgttatgtcttcggaactgggaccaaggtcaccgtcttgagtcagcccaaggccaaccccaaacccccg

SEQ ID NO: 788523 - DNA, 442 bp, Homo sapiens
  misc_feature: NA.19.25.C03.1.454.light.4.zerom50
aaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcagactttcggcggagggaccgaaggtggagatcaaacgaactgtggctgcaccatctgtttcg

SEQ ID NO: 788524 - DNA, 403 bp, Homo sapiens
  misc_feature: NA.7.18.B07.1.454.light.4.zerom50
agggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctctagagacacg

SEQ ID NO: 788525 - DNA, 449 bp, Homo sapiens
  misc_feature: NA.47.52.E08.1.454.light.4.zerom50
agagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaagggaccgaacggtggaaagtacaaacgaactacgtggctgcacca

SEQ ID NO: 788526 - DNA, 471 bp, Homo sapiens
  misc_feature: NA.9.88.H11.1.454.light.4.zerom50
aacacacaaaggggggggtctcaggaggcagcactctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccggcactgacgttggtcgttttgtctatgtctcctggtaccagcagcacccaggcaaaggccccaaactcgtcctttatgaagcctctaagcggccctcagggatccctgatcgcttctctggctccaggtctggcaacacggcctccctgaccgtctctggactccagcctgacgatgaggctatttattactgcagtgcatatgcaggcagtaatactttggttttcggcggagggaccacggtgaccgtcctaagtcagcccaaggctcgccccctcggtcactc

SEQ ID NO: 788527 - DNA, 463 bp, Homo sapiens
  misc_feature: NA.52.11.A11.1.454.light.4.zerom50
agggggatcaggactcctcagttcaccttctcacaatgaggctccctgctcagctcctggggctgctaatgctctgggtcccagggtgcactggggatgttgtggtgactcagtctcctctctccctgcccgtcacccttggacaggcggcctccatctcctgcaggtctagtcacagcctcctacacagtgatggaaacacctacttgagttggtttcagcagaggcctggccaatctccaaggcgccttatttataaggtttctaatcgggactctggggtcccagacagattcagcggcagtgggtcaggcactgacttcacactgaaaatcagcagggtggaggctgaggatgttggggtttattactgcatgcaaggtacacactggcctccgtacacttttggccgaggggaccgaagctcgagatacaaaggaactagtggctgcaccatacttcg

SEQ ID NO: 788528 - DNA, 476 bp, Homo sapiens
  misc_feature: NA.14.7.A07.1.454.light.4.zerom50
agggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatgggttttggctatttcggtgttcggcggagggacccaggtgaccgtcctacgtcagcccaaggtccg

SEQ ID NO: 788529 - DNA, 477 bp, Homo sapiens
  misc_feature: NA.7.39.D06.1.454.light.4.zerom50
cagttctttgggggtgggctcaggaggcagagctctgggaatctcaccatggcctggacccctctcctgctccccctcctcactttctgcacagtctctgaggcctcctatgaactgacacagccaccctcggtgtcagtgtccccaggacaaacggccaggatcacctgctctggaaatccatcgccaataagatctgttcattggtaccaccagaggtccggccaggcccctgtgcttgtcgtctatgcggacacaaagcgcccctccgggatccctgagagattctctggctccagctcagggacagtggccaccttgactatcagcggggcccaggtggacgatgaaggtgactacttctgtttctcaatagacgccagcggtgaccatagggtgttcggcggagggaccagggtgaccgtcctaggtcagcccaaggctgccccctcggtcactctcgttcccgccctcccs

SEQ ID NO: 788530 - DNA, 440 bp, Homo sapiens
  misc_feature: NA.5.52.E08.1.454.light.4.zerom50
aagagagaaaggggctgatcaggactcctcagttcaccttctcacaatgaggctccctgctcagctcctggggctgctaatgctctgggtctctggatccagtggggagattgtgctgactcagtctccactctccctgcccgtcacccctggagagccggcctccatctcctgcaggtctagtcagagcctcctgcatagtaatggattcaactatttggattggtacctgcagaggccagggcagtctccacagctcctgatctatttgggctcttatcgggcctccggggtccctgagaggttcagtggcagtggatcaggcacagactttacactgagaatcagcagagtggaggctgaggatgttggggtttattactgcatgcaagctctacaaaccctattcactttcggccctgggaccagagtggataacg

SEQ ID NO: 788531 - DNA, 445 bp, Homo sapiens
  misc_feature: NA.4.72.G06.1.454.light.4.zerom50
aggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcggccgaagggaccgaacggtaggaaagtacaaacgaactagtggcgtgcaccatcttcg

SEQ ID NO: 788532 - DNA, 458 bp, Homo sapiens
  misc_feature: NA.8.75.G09.1.454.light.4.zerom50
aggggagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcagctccaacatcggaactaatactgtaaactggtaccagcaactcccaggaacggcccccaaactcctcatctatcatagtgatcagcggccctcaggggtccctgaccgattctctggctccaagtctgccacctcagcctccctggccatcagtgggctccagtctgaggatgaggctgattattactgtgcagcatgggatgacagcctgaatggcctggtattcggcggagggaccaaagtgaccgtcctaggtcagcccaaggctcgccccctcg

SEQ ID NO: 788533 - DNA, 469 bp, Homo sapiens
  misc_feature: NA.51.2.A02.1.454.light.4.zerom50
agaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatgccgaccggccctcagggatccctgaacgattctctggctccagctctgagaacacggccaccctgagcatcagcagggtcgaagccggggatgaggccgactattactgtcaggtgtgggatactagtagtgatcatgtcttcggacctgggaccaaggtcaccgtcctaggtcagcccaaggccaaccccactgtcactctgttcccacccttccc

SEQ ID NO: 788534 - DNA, 462 bp, Homo sapiens
  misc_feature: NA.10.7.A07.1.454.light.4.zerom50
agggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattaggagctccttagcctggtaccaacagaaatatggccaggctcccaggctcctcatctatgaaacatccaatagggccactgccatccctgccaggttcagtggcagtgggtctgggacagacttcactctcatcatcagcggcctagagcctgaagattctgcagtttactactgtcagcaccgtaccgagtggcctccccaacccactttcggcggagggaccaaggtggagatcaaacgaactgtggctgcaccatctgtcttcatcttccccg

SEQ ID NO: 788535 - DNA, 456 bp, Homo sapiens
  misc_feature: NA.16.12.B01.1.454.light.4.zerom50
tccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcagcggggcccagactatggatgaggctgactattactgtcaggcgtgggacagcaattctgtgattttcggcggagggaccaagttgaccgtcctaggtcagcccaaggctgccccctcggtcactcttcg

SEQ ID NO: 788536 - DNA, 448 bp, Homo sapiens
  misc_feature: NA.52.12.B01.1.454.light.4.zerom50
tccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaattgggggataaatatgtttcctggtatcagcagaagccaggccagtcccctgcgttggtcatctatcaagataccaagaggcgctcagggatccctgagcgattctctggctccaactctggggacacagccactctgaccatcagcgggacccagactctggatgaggctgactattactgtcaggcgtgggacagcagcacgggggtgttcggcggagggaccaagctgaccgtcctaggtcagcccaaggctcgccccctcggt

SEQ ID NO: 788537 - DNA, 447 bp, Homo sapiens
  misc_feature: NA.12.26.C04.1.454.light.4.zerom50
agctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagtttatttttgtcagcaatattatcatactccgctcactttcggcggagggaccaaggtggagatcaaacgaactgtggctgcaccta

SEQ ID NO: 788538 - DNA, 439 bp, Homo sapiens
  misc_feature: NA.11.11.A11.1.454.light.4.zerom50
aggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgtcttca

SEQ ID NO: 788539 - DNA, 441 bp, Homo sapiens
  misc_feature: NA.16.4.A04.1.454.light.4.zerom50
agggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtggggtcccatcaagattcagcggcagtggatctgggacagagttcactctcaccatcagcagcctgcagcctgatgattttgcaacctattattgccaacagtataatagttatccgtggacgttcggccaagggaccgagggtggacgatacaaacgaactagtggctgcacctac

SEQ ID NO: 788540 - DNA, 459 bp, Homo sapiens
  misc_feature: NA.4.3.A03.1.454.light.4.zerom50
aaggggggagaagagctgctcagttaggacccagagggaaccatggaaaccccagcgcagcttctcttcctcctgctactctggctcccagattctgccggagaagttgtcttgacgcagtctccaggcaccctgtctttgtctccaggtgaaagagccaccctctcctgccgggccagtgagagtcttagcggcgactacttagcctggtaccagcaaaaacctggccagtctcccaggctcctcatctctggtgtatccttcagggccactggcatcccagacagattcaggggcagtgggtctgggacagacttcactctcaccatcagcagactggagcctgaagactttgcgctgtatttctgtcagcagtatgttttcgcacctttcactttcggcggagggaccaaggtggagaacaaacgaactgtggctgcaccatctgtcttcattccc

SEQ ID NO: 788541 - DNA, 454 bp, Homo sapiens
  misc_feature: NA.17.1.A01.1.454.light.4.zerom50
agggggcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatcaacaaaaactagggagagcccctaaactcctgatctatgctgcatccagtttgcagactggggtcccatcaaggttcagcggcagtggatctggcacagatttcactctcaccatcagcagcctgcagcctgaagattttgcaacttattactgtctacaagattacgattaccctcggacgttcggtccaacgggaccgaacggtaggaggagtcaaacgaactagtggctgcaccactcttcg

SEQ ID NO: 788542 - DNA, 462 bp, Homo sapiens
  misc_feature: NA.13.9.A09.1.454.light.4.zerom50
aggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaaataccaggcggccctctggggtccctgagcgattctccggctccgcctctgggaacacagtcactctgaccatcagcgggacccagcctattgatgaggctgtctacttctgtcaggcgtgggacaacagcgtgctgttcggcggagggaccagtctgaccgtcttaggtcagcccaaggctcgccccctcggtcactctcgttccctacccccg

SEQ ID NO: 788543 - DNA, 473 bp, Homo sapiens
  misc_feature: NA.53.44.D11.1.454.light.4.zerom50
aggggctgggcctaaggaagcagcactggtggtgcctcagccatggcctggaccgttctcctcctcggcctcctctctcactgcacaggctctgtgacctcctatgtgctggctcagccaacctcggtgtcggtggccccaggacagacggccaccattacctgtgggggagaggacattggaagcaaaagagtgcactggtaccagcagaagtcaggccaggcccctgtgctggtcatctatggtggaagaaaccggccctcatggatccctgagcgattgtctggctccaactctggcaatatggccaccctaatgatcagaagggtcgaagccggggatgaggccgactattactgtcaggtgtgggatagtagtagtgatcggaattgggtgttcggcggagggaccaagctgaccgtcctaggtcagcccaaggctgccccctcggtcactctgttcccgcccttccc

SEQ ID NO: 788544 - DNA, 457 bp, Homo sapiens
  misc_feature: NA.41.75.G09.1.454.light.4.zerom50
agggggctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcgactacttagcctggtaccagcagaaacctggccaggctcccaggctcctcatggatggtgcatccagcagggccactggcatcccagacaggttcggtggcagtgggtctgggacagacttcactctcaccatcagcagcctggagcctgaagattttgtagtgtattactgtcagcagtatcttacaacaccgggtagttttggccgaggggaccaaggctggagatcaaacgaactgtggctgcaccatctgtcttcatycttcccgw

SEQ ID NO: 788545 - DNA, 434 bp, Homo sapiens
  misc_feature: NA.4.26.C04.1.454.light.4.zerom50
tgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgtaacg

SEQ ID NO: 788546 - DNA, 432 bp, Homo sapiens
  misc_feature: NA.4.69.G03.1.454.light.4.zerom50
caggagtcagtctcagtcaggacacagcatggacatgagggtccccgctcagctcctggggctcctgctactctggctccgaggtgccagatgtgacatccagatgacccagtctccatcctccctgtctgcgtctgtaggtgacagcgtcaccatcacttgccgggcaagtcagagtattagtatctatttaaattggtatcagcagaaaccagggaaagtccctaagctcctgatctatggtgcattcaacttgcaaagtgggatcccatcacggttcagtggcagtggatctgggacagatttcactctcaccatcagcagtctgcaacctgaagattttgcaacttacttctgtcaccagagtcacagtacccctcacacttttggccaggggaccaacttagagatacaaacgaactagtggactcg

SEQ ID NO: 788547 - DNA, 446 bp, Homo sapiens
  misc_feature: NA.4.66.F11.1.454.light.4.zerom50
agggaaaggggcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaacttactattgtcagagttctaattctttcccgcgcacgtttggccaggggaccaaggtagagatcaaacgaactgtggctgcaccatctgtcttcatcttccccg

SEQ ID NO: 788548 - DNA, 444 bp, Homo sapiens
  misc_feature: NA.43.64.F09.1.454.light.4.zerom50
agggggagtcagtctcagtcaggacacagcatggacatgagggtccccgctcagctcctggggctcctgctactctggctccgaggtggcagatgtgacatccagatgacccagtctccatcctccctgtctgcatctgtgggggacagagtcaccatcacttgtcgggcaagtcagtccgttaggcattatttaaattggtatcggcagagaccagggatggcccctcagctcatgatctacgctgcttccactctgcaaattggggtcccatcaacgttcagtggcagtgggtctgggacatatttcactctcaccatcaccagtctggaacctgaagattttgcaacttacttctgccaacagacttacagtctccctctcactttcggcggagggaccacagtggagatcaaaggaactgtggctgcaccatctgttctt

SEQ ID NO: 788549 - DNA, 446 bp, Homo sapiens
  misc_feature: NA.41.72.G06.1.454.light.4.zerom50
ctccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcatgggacagcagcctcacaaattggatgttcggcggagggaccaagctgaccgtcctaggtcagcccaacgctccg

SEQ ID NO: 788550 - DNA, 462 bp, Homo sapiens
  misc_feature: NA.40.56.F01.1.454.light.4.zerom50
aacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggccagtcggaggatttatacctggttggcctggtatcagcagaaaccagggaaagcccctgacctcctgatctttaaggcgtctactttggagacatgggtcccatcaaggttcagcggcagtggatccgagacagaattcactctcaccatcagcagcctgcagccggatgattttgcaacttattactgccaacaatattacagttatcctcggacgttcggtccagggaccgacggtggaaagtacagacgaactagtggcgtgcaccactctgtcttcta

SEQ ID NO: 788551 - DNA, 461 bp, Homo sapiens
  misc_feature: NA.10.82.H05.1.454.light.4.zerom50
ctctgcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatcccaggaggtgcccccaaactcctcatatatgaagatgataagcgaccgtcagggattcctgaccgattctctggctccaagtctggcacgtcggccaccctgggcatcgccggactccagactggggacgaggccgatttttactgcggaacatgggataccagcctgcatggtgtggttttcggcggagggaccaagctgaccgtcctaagtcagcccaaggctcgccccccg

SEQ ID NO: 788552 - DNA, 458 bp, Homo sapiens
  misc_feature: NA.26.29.C07.1.454.light.4.zerom50
agggaaagggactgactaccacctgcaggtcagggccaaggttatgggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaaacgaactgtggctgcaccatctgtcttcatcttcccgccact

SEQ ID NO: 788553 - DNA, 462 bp, Homo sapiens
  misc_feature: NA.17.41.D08.1.454.light.4.zerom50
agagaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccgccattc

SEQ ID NO: 788554 - DNA, 479 bp, Homo sapiens
  misc_feature: NA.21.30.C08.1.454.light.4.zerom50
aagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgccaaaaaattatgttttttggtaccagcagaagtcaggccaggcccctgtgttggtcatccatgaggacaggagacgaccctccgggatccctgagagattctctggctccaactcagggacggtggccacgttgattctcagtggggcccaggtggaggatgaagctgactactactgttactcagcagacagcagtggtcatcagggggcattcggcggagggaccaggttgaccgtcctaggtcagcccaaggctgccccctcggtcactctgttcccgccctcctcccgg

SEQ ID NO: 788555 - DNA, 465 bp, Homo sapiens; identical to SEQ ID NO: 787572
  misc_feature: NA.18.33.C11.1.454.light.4.zerom50

SEQ ID NO: 788556 - DNA, 457 bp, Homo sapiens
  misc_feature: NA.3.70.G04.1.454.light.4.zerom50
aaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccacttagcctggtaccagcagaaacctggccagcctcccagtctcctcatctatggagcacacaacagggccactggcatcccagccaggttcagtggcagtgggtctgggacagacttcaccctcatcatcagccgcctagagcctgaagattttgcagtttattactgtcagcagggttacttctggcccactttcggccctgggaccaaagtggatatcaaacgaactgtggctgcaccatctgtcttcatcttcccgccatctcgta

SEQ ID NO: 788557 - DNA, 513 bp, Homo sapiens
  misc_feature: NA.27.33.C11.1.454.light.4.zerom50
ttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttagccccgtttcatcttcccgccatctacgaagaccgacg

SEQ ID NO: 788558 - DNA, 454 bp, Homo sapiens
  misc_feature: NA.3.49.E05.1.454.light.4.zerom50
aacacacaaagggggaagagctgctcagttaggacccagagggaaccatggaaaccccagcgcagcttctcttcctcctgctactctggctcccagataccaccgcagaaattgttttgacgcagtctccaggcaccctgtctttgtctccaggggaaagagccaccctctcctgcagggccagtgagagtgttaacaataggtacttaggctggtaccagcagaagcctggccaggctcccaggctcctcatctatagtgcgtccagcagggccactggcatcccagacaggttcagtggcagtgggtctgggacagacttcactctcaccatcaccagactggagcctgaggattttgcagtgtatttctgtcagcagtatggtgactcacttgcgttcggccaagggaccaaggtggaaatcaaacgaactgtggctgcaccatctgtctt

SEQ ID NO: 788559 - DNA, 452 bp, Homo sapiens
  misc_feature: NA.9.81.H04.1.454.light.4.zerom50
tctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggaccacggtcaccgtcctaggtcagcccaaggccaaccccactgtcacttccg

SEQ ID NO: 788560 - DNA, 470 bp, Homo sapiens
  misc_feature: NA.41.40.D07.1.454.light.4.zerom50
taacaacagaggggagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttctatcttccccg

SEQ ID NO: 788561 - DNA, 439 bp, Homo sapiens
  misc_feature: NA.10.72.G06.1.454.light.4.zerom50
tctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaacgcc

SEQ ID NO: 788562 - DNA, 446 bp, Homo sapiens
  misc_feature: NA.9.50.E06.1.454.light.4.zerom50
aggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccgaacgggaccgaaagtaggacgatacaagcgaactagtggcgtgcaccactcttcg

SEQ ID NO: 788563 - DNA, 428 bp, Homo sapiens
  misc_feature: NA.2.82.H05.1.454.light.4.zerom50
tgggtccaggaggcagaactctgggtgtctcaccatggcctggatccctctacttctccccctcttcactctctgcacaggctctgaggcctcctatgagctgacacagccaccgtcggtgtcagtgtccccaggacagacggccaggatcacctgctctggagatgcattgccagatcaatatgctaattggtaccagcagaagccaggccaggcccctgtgctggtgatatataaagacagtgagaggccctcagggatccctgagcgattctctggctccagctcagggacaacagtcacgttgaccatcagtggagtccaggcagaggatgaggctgactattactgtcaatcagcagacaccagtggtaatgattatgtcttcggaactgggaccaaggtcaccgtcctaggtcagaccccgc

SEQ ID NO: 788564 - DNA, 455 bp, Homo sapiens
  misc_feature: NA.11.16.B05.1.454.light.4.zerom50
aktkgggtttggggctgatcaggacgtcctcagttacaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgtctcgcattcggcgggagggaccrarggtggaggatcaaacgaa

SEQ ID NO: 788565 - DNA, 477 bp, Homo sapiens
  misc_feature: NA.47.87.H10.1.454.light.4.zerom50
ttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtgggagactaattttggtcatatgttgttcggcggagggaccaagctgaccgtcctcggtcagcccaaggctgccccctcggtcactctgttcccaccctcctc

SEQ ID NO: 788566 - DNA, 421 bp, Homo sapiens
  misc_feature: NA.22.16.B05.1.454.light.4.zerom50
ccttgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccaccctcctcacgcgtatgt

SEQ ID NO: 788567 - DNA, 462 bp, Homo sapiens
  misc_feature: NA.22.27.C05.1.454.light.4.zerom50
agggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtggctgcacctattc

SEQ ID NO: 788568 - DNA, 453 bp, Homo sapiens
  misc_feature: NA.47.80.H03.1.454.light.4.zerom50
aagggaaagggggagtcagtctcagtcaggacacagcatggacatgggagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagtattttgcaacttactactgtcaacagagttaccggtaccccgtacacttttggccaggggaccaaactggacatcaaacgaactagtggctgcaccatcttcg

SEQ ID NO: 788569 - DNA, 446 bp, Homo sapiens
  misc_feature: NA.14.28.C06.1.454.light.4.zerom50
agtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttctatcttccccg

SEQ ID NO: 788570 - DNA, 514 bp, Homo sapiens
  misc_feature: NA.14.67.G01.1.454.light.4.zerom50
ttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttagcccccgttacatcttcccgccatctgagtactagacgc

SEQ ID NO: 788571 - DNA, 362 bp, Homo sapiens
  misc_feature: NA.47.14.B03.1.454.light.4.zerom50
ttgggtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccaccctcctctacgtgagct

SEQ ID NO: 788572 - DNA, 443 bp, Homo sapiens
  misc_feature: NA.15.71.G05.1.454.light.4.zerom50
tcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccaccaaggttcagcggcagtgaatctgggacagatttcactctcaccatcagcagcctgcagcctgaggattttgcaacttactattgtcaacaggctaacagtttccctctcactttcggcggagggaccaaggtggatatcaaacgaactgtggctgcacctac

SEQ ID NO: 788573 - DNA, 438 bp, Homo sapiens
  misc_feature: NA.52.40.D07.1.454.light.4.zerom50
taacaacagaggggcagtcccagtcaggacacagcatggacatgagggtccccgctcagctcctggggctcctgctgctctggctcccaggtgccagatgtgacatccagttgacccagtctccatccttcctatctgcatctgtaggagacagagtcaccatcacttgtcgggcgagtcagggtattagcagctggttagcctggtatcagcagaaaccagggaaagcccctaagctcctgatctatgctgcatccactttgcagagtggggtcccatcaaggttcagcggcagtggatctgggagacaattcactctcacaatcagcagcctgcagcctgaagattttgcgacttattactgtcaacaacttaatcgttaccctcttttcggccctgggaccaaagtggatatcaaacgaactgtggctgcaccat

SEQ ID NO: 788574 - DNA, 445 bp, Homo sapiens
  misc_feature: NA.48.6.A06.1.454.light.4.zerom50
aggrggsrggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggtccaagggaccgaaggtggaaatacaaacgaaactagtggctgcaccat

SEQ ID NO: 788575 - DNA, 468 bp, Homo sapiens
  misc_feature: NA.17.10.A10.1.454.light.4.zerom50
aaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctggaaaccccccaatgttggattcaattatgtgtcctggtaccagcaactcccgggatcagcccccaaactcctcatatatgaagataataagcgaccctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctcgcgccccg

SEQ ID NO: 788576 - DNA, 447 bp, Homo sapiens
  misc_feature: NA.3.40.D07.1.454.light.4.zerom50
taacaacagagggggagtcagactcagtcaggacacagcatggacatgagggtccccgctcagctcctggggctcctgctgctctggctcccaggtgccagatgtgacatccagatgacccagtctccttccaccctgtctgcctctataggagacagagtcaccatcacttgcggggccagtcagagtataagtaatttgttggcctggtatcagcagaaaccaggcaaagccccaaagctccttatttctgatgcctccactttgcacgttggggtcccaccaacgttcagcggcagtggatctgggacagatttcactctcaccatcagcagcctgcagcctgatgatgttgcaacttattactgtcaacaatataacacttattggacgttcggccaggggaccaaggtggaaatcaaacgaactgtggctgcaccatctgtt

SEQ ID NO: 788577 - DNA, 460 bp, Homo sapiens
  misc_feature: NA.8.86.H09.1.454.light.4.zerom50
ttgggtttgggggagagactgaagaacccagccttgcagcagctccaccatggcctgggctcctctgctcctcaccctcctcagtctcctcacagggtccctctcccagcctgtactgactcagccaccctctgcatcagcctccctgggagcctcggtcacactcacctgcaccctgagcagcggctacagtaattataacgtggactggtaccagcagagaccagggaagggcccccggtttgtgatgcgagtgggcactggtgggattgtgggatccaagggggaaggcttccctgatcgcttctcagtcttgggctcaggcctgaatcggtacctgaccatcaagagcatccaggaagaggatgagagtgactactactgtggggcagaccatggcagtgccactggaaacaacttcgtgtatgtgttcggcggagggactaagctgaccgtccta

SEQ ID NO: 788578 - DNA, 459 bp, Homo sapiens
  misc_feature: NA.47.66.F11.1.454.light.4.zerom50
agggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttattactgtcagcagcgtaacaattggccgatcaccttcggccaagggacacgactggagattaaacgaactgtggctgcaccatctgtcttcatcttcccgccat

SEQ ID NO: 788579 - DNA, 453 bp, Homo sapiens
  misc_feature: NA.21.4.A04.1.454.light.4.zerom50
aagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaagggaccaaggtagaaatgaaacgaactgtggctgcaccatctgtt

SEQ ID NO: 788580 - DNA, 494 bp, Homo sapiens
  misc_feature: NA.17.75.G09.1.454.light.4.zerom50
aggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaatttatgatgcgaccaacagacactcctgggcgcctggccgtttttcgggctccctcctcgggggcaaagctgccctgaccctaacgggggcgcagcctgaggacgaggccgactattattgcctactatcatttgatggtggtcgtctgcccattttcggcggcgggaccagggtggccgtcctgggtcagcccaaggctgccccctcggtcactctgttcccaccctcctcctagtctacgtctcgtagc

SEQ ID NO: 788581 - DNA, 456 bp, Homo sapiens
  misc_feature: NA.10.63.F08.1.454.light.4.zerom50
agggggaggaactgctcagttaggacccagagggaaccatggaagccccagctcagcttctcttcctcctgctactctggctcccagaaactaccgcagaaattgtgttgacacagtctccagccaccctgtctttgtctccaggggaaagagccaccctctcctgcagggccagtcagagtgtttcccgctacttagcctggtaccaacagaagcctggccaggctcccaggctcctcatgtatgatgcatccaacagggccactggcatcccagccaggttcagtggcagtgggtctgcgacagacttcactctcaccatcaacagcctagaacctgaagattttgcactttatttctgtcaccagagtcgcaactggcctccgacgttcggccaggggaccaaggtggagatcagacgaactgtggctgcaccatctgtcttcatcttcccgt

SEQ ID NO: 788582 - DNA, 409 bp, Homo sapiens
  misc_feature: NA.2.73.G07.1.454.light.4.zerom50
agggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtactttttcggcggagggaccaagctgaccgtcctgggtcagcccaaggctgccccctcggtcactctgttccccaccctcctctgtcgagcgt

SEQ ID NO: 788583 - DNA, 453 bp, Homo sapiens
  misc_feature: NA.40.50.E06.1.454.light.4.zerom50
ctggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggagacaccggtgatattgggacttataaccttgtctcttggtaccaacagcacccaggcaaagcccccaaacttatgatttatgagggcagccagcggccctcatggatttctagtcgcttctctgcctccaagtctggcaacacggcctccctgacaatctctggactccaggctgaggacgaggctgagtattactgctgcgcatttgcaggtagtagcgccccttatgtcttcgggactgggaccaaggtcacagtcctaggtcagcccaaggatgccccccg

SEQ ID NO: 788584 - DNA, 446 bp, Homo sapiens
  misc_feature: NA.52.31.C09.1.454.light.4.zerom50
ctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaggtcaggccaggcccctatattgatcatctatgaagacagcaaacgacccgctgggatccctcagagattctctggctccagctcagggacaatggccaccttgactatcactggggcccaggtggaggatgaagctgccttctattgtttttcaacagacagcagtggtaatcatagggtgttcggcggagggaccaggctgaccgtcctaggtcagcccaaggctcgccccctcggtc

SEQ ID NO: 788585 - DNA, 467 bp, Homo sapiens
  misc_feature: NA.8.16.B05.1.454.light.4.zerom50
gtttggggtttgagggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttccygcc

SEQ ID NO: 788586 - DNA, 403 bp, Homo sapiens
  misc_feature: NA.8.11.A11.1.454.light.4.zerom50
agggtcctgggcccagtccgtgctgacgcagccgccctcagtgtctggggccccaggccagagggtcgccatctcctgcactgggaacaactccaacatcggggcaggtcatgatgtacattggtaccagcagtttccaggaaaagcccccggactcctcatttttgttaacaacgatcgcccctcaggggtccctgaccgcttctctggctccaggtctggcgcctctgcctccctggccatcgctgggctccaccttgacgatgagggtttttattactgccagtcgtacgacgacagtctgactgccccggtgttcggcggcgggaccaaggtgaccgtcctgagtcagcccaaggctgcccccacggtcactctgttcccaccctcctcgacacgcgag

SEQ ID NO: 788587 - DNA, 455 bp, Homo sapiens
  misc_feature: NA.26.14.B03.1.454.light.4.zerom50
tygggtttaggggaggaactgctcagttaggacccagagggaaccgatggaagaccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctggggacagacttcactctcaccatcagcagcctagagcctgaagattttgcactttattactgtcagcagcgtagcaactggcctctcactttcggcggagggaccgagggtggaggatcagacgaactgtggctgcaccatctgtt

SEQ ID NO: 788588 - DNA, 457 bp, Homo sapiens
  misc_feature: NA.13.64.F09.1.454.light.4.zerom50
agggggagtcagtctcagtcaggacacagcatggacatgagggtccccgctcagctcctggggctcctgctactctggctccgaggtgccagatgtgacacccagctgacccagtctcctgttttcctgtctgcctctgtgggcgacagagtcgacatcacttgccgggcaagtcagaatattaagacctatttgaattggtatcagcaaacaccagggaaagcccccaaactcctgatcttcggttcatctcgtttgcaaagtggagtcccttcacggttcagtggcagtggatctgggacagacttcactctcaccatcggcagtcttcaacgtgacgactttgcaacgtactactgtcaacagacctacagtacacctcacagttttggccaggggaccaaggtggaagtcaagggaactgtggctgcaccatctgtcttcatcttcccgccat

SEQ ID NO: 788589 - DNA, 445 bp, Homo sapiens
  misc_feature: NA.5.16.B05.1.454.light.4.zerom50
agggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactagtcaacagagttacgatacccctccgctcactttcggcggagggaccaaggtggagatcaaacgaactgtggctgcaccatctgtt

SEQ ID NO: 788590 - DNA, 444 bp, Homo sapiens
  misc_feature: NA.41.36.D03.1.454.light.4.zerom50
atctctcttggggctccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgtacccgtccgac

SEQ ID NO: 788591 - DNA, 440 bp, Homo sapiens
  misc_feature: NA.47.61.F06.1.454.light.4.zerom50
aggaactgctcagttaggacccagacggaaccatggaagccccagcgcagcttctcttcctcctgctactctggctcccagakaccactggmraaatagtgmtgacgcagtctccagccaccctgtctgyctctccaggggaaagagycaccatctcctgtmgggccggtcagagtattagcakcaacttagcctggyaccagcagaracctgggcaggctcccaggctcctcatctwtgatgcgtccaccagggccactggtttcccagccaggttcagtggcagtgcgtctgsgacagagttcactctcaccatcaacagcctgcagtctgaagtattttgctagtttattactgtcagcagtatcatractggccgctcaccttcggccaagggacacgacgtggagattaaacgaactgtggctgcaccatctgtt

SEQ ID NO: 788592 - DNA, 453 bp, Homo sapiens
  misc_feature: NA.40.82.H05.1.454.light.4.zerom50
cacgaccggtgctcgatttagagtgagctcgttgggtttggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatggtggggggtgccgacttgggtggttcggcggac

SEQ ID NO: 788593 - DNA, 451 bp, Homo sapiens
  misc_feature: NA.4.5.A05.1.454.light.4.zerom50
agggggaggaactgctcagttaggacccagacggaaccatggaagccccagcgcagcttctcttcctcctgctactctggctcccagataccactggagaaatagtgatgacccagtctccagccaccctgtctgtgtctccaggggaaagagccaccctctcctgcagggccagtcagagtgttgacggcaacttagcctggtaccagcagaaacctggccaggctcccagactcctcatctacggtccatccactagggccactggtgtcccacccaggttcagtggcagtggatctgggacagagttcactctcaccatcagtagcctgcagtctgaagattttgcactttatttctgtcagcaatataataactggcctccttcaagcagttttggccaggggaccaagctggagatcaaacgaactgtggctgcaccatctgtctt

SEQ ID NO: 788594 - DNA, 446 bp, Homo sapiens
  misc_feature: NA.8.81.H04.1.454.light.4.zerom50
agtcagacccagtcaggacacagcatggacatgagggtccccgctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtactttttctccggtacacttttggccgggggaccaagctggagatcaaacgaactgtggctgcaccatctgtcttctacc

SEQ ID NO: 788595 - DNA, 450 bp, Homo sapiens
  misc_feature: NA.10.2.A02.1.454.light.4.zerom50
agggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagattttgcagtttattactgtcagcagtataatagctggcccgcgacgttcggccaagggaccgaggtggaattcaaacgaactgtggctgcaccatctgtcttctwta

SEQ ID NO: 788596 - DNA, 467 bp, Homo sapiens
  misc_feature: NA.14.78.H01.1.454.light.4.zerom50
agggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctcgccccctcggtcactctgttcccccg

SEQ ID NO: 788597 - DNA, 431 bp, Homo sapiens
  misc_feature: NA.3.82.H05.1.454.light.4.zerom50
caggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggagatcaaacgaactgtggctgcaa

SEQ ID NO: 788598 - DNA, 453 bp, Homo sapiens
  misc_feature: NA.4.2.A02.1.454.light.4.zerom50
agggggcaaggggagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcaccatctgtcttctac

SEQ ID NO: 788599 - DNA, 434 bp, Homo sapiens
  misc_feature: NA.3.50.E06.1.454.light.4.zerom50
caggagtcagtctcagtcaggacacagcatggacatgagggtccccgctcagctcctggggctcctgctactctggctccgaggtgccagatgtgacatccagatgacccagtctccatcctccctgtctgcatctgtaggggacagagtcaccatcacttgccgggcaagtcagagtattagcaggtatttaaattggtatcagcaaaaaccagggaaagcccctaaacttttgatctatgctgcatccagtttgcaaagtggggtcccatcaaggttcaatggcagtggatctgggacagatttcactctcaccatcagcagtctacagcctgaagattttgcaacttactactgtcaacagagttacagtacttggtatttcactttcggccctgggaccaaagtggacatcaaacgaactgtggctgcac

SEQ ID NO: 788600 - DNA, 441 bp, Homo sapiens
  misc_feature: NA.4.76.G10.1.454.light.4.zerom50
aggggaggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctccttatctctgatgcctccactttgcacggtggcgtcccaccaacgttcagcggcagtggatctgggacagaattcactctcaccatcagcagcctgcagcctgatgatgttgcaacttattactgtcaacaatataacaattattggacgttcggccaagggaccaaggtggaaatacaaacgaactagtggctgcacctacttc

SEQ ID NO: 788601 - DNA, 460 bp, Homo sapiens
  misc_feature: NA.8.64.F09.1.454.light.4.zerom50
aggggcagcactcaggacaatctccagcatggcctggtctcctctcctcctcactctcctcgctcactgcacagggtcctgggcccagtctgagctgacgcagccgccctcagtgtctggggccccagggcagagggtcaccatctcctgcactggggacaactccaacatcggggcaggttataatgtttactggtatcaacaacttccagggacagcccccaaactcctcttgtatggtgacaactatcggccctcaggtgtccctgaccggatctctggctccaagtctggcacctcagcctccctggccatcactgggctccaggctgaagatgaggctgattattactgccagtcttatgacagccgcctgagtggctatgtgcttttcggcgggggaccaagctgaccgtcctacgtcagcccaaggctgccccctcggtcactctgttccccg

SEQ ID NO: 788602 - DNA, 446 bp, Homo sapiens
  misc_feature: NA.12.8.A08.1.454.light.4.zerom50
aggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaaataccaggcggccctctggggtccctgagcgattctctggctccgactctgggaacacagtcactctgaccatcagcgggacccaggctattgatgaggctgtctactactgtcaggcgtgggacagcagcgtggtgttcggcggagggaccagtctgaccgtcttaggtcagcccaaggctgccccctcggtctaccg

SEQ ID NO: 788603 - DNA, 445 bp, Homo sapiens
  misc_feature: NA.48.49.E05.1.454.light.4.zerom50
aacacacaaagggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcgtacgttcggccaagggaccaaggtggaaatcaaacgaactgtggctgcwcgga

SEQ ID NO: 788604 - DNA, 463 bp, Homo sapiens
  misc_feature: NA.51.19.B08.1.454.light.4.zerom50
aggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcattatttatgaggccagtaggcgagcctcagggatttctagtcgcttctctgcctccgcgtctggcaacacggcctccctgacaatttctgggctccagcctgaggacgagtctcactactactgctcctcatatgcagacaatagtttcctggtgttcggcggagggaccaagttgaccgtcctaggtcagcccaaggctgccccctcggtcacttcs

SEQ ID NO: 788605 - DNA, 458 bp, Homo sapiens
  misc_feature: NA.14.36.D03.1.454.light.4.zerom50
atctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggcggggggaccgaaggtgaccgtcctaggtcagcccaaggccg

SEQ ID NO: 788606 - DNA, 452 bp, Homo sapiens
  misc_feature: NA.13.25.C03.1.454.light.4.zerom50
tcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggttcttctgtggtcttcggcggagggtccaaagtgaccgtcctaggtcagcccaaggctgccccctcggtcacttccg

SEQ ID NO: 788607 - DNA, 460 bp, Homo sapiens
  misc_feature: NA.22.20.B09.1.454.light.4.zerom50
aggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccgggtcagactatctgctcaccatcggcggtctggaacctgaagattctgcactatattactgtcagctttatgttaattcacctccgtcgtacatctttggccaggggaccaagctggagatcaaacgaactgtggctgcaccatctgtcttcattcccg

SEQ ID NO: 788608 - DNA, 435 bp, Homo sapiens
  misc_feature: NA.5.71.G05.1.454.light.4.zerom50
agctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtgtcttacacagctccagcaataagaaccacttagcttggtaccagcagaaaccaggacagcctcctaaggtactcatttactgggcatctacccggggatccggggtccctgaccgattcagtggcagcgggtctgggacagatttcactctcaccatcagcagtctgcaggctgaagatgtggcagtttattactgtcagcaatattataccactccgtgcagttttggcctggggaccaagctggagatcaaacgaactt

SEQ ID NO: 788609 - DNA, 439 bp, Homo sapiens
  misc_feature: NA.49.51.E07.1.454.light.4.zerom50
caggagtcagtcccagtcaggacacagcatggacatgagggtccccgctcagctcctggggctcctgctgctctggctcccaggtgccagatgtgacatccagttgacccagtctccatccttcctgtctgcatctgtcggagacagagtcaccatcacttgccgggccagtcagggcgttagtagttatttagcctggtatcaacaaaaaccagggaaagcccctaacctcctgatatatgctgcaaccactttgcaaagtggggtcccatcaaggttcagcggcagtggatctgggacagagttcactctcactatcagcagcctgcagcctgaagattttgcaacttattattgccatcaagttgatgcttacccgctcactttcggcggagggaccaaggtggagatcagacgaactgtggctgcaccatcytcg

SEQ ID NO: 788610 - DNA, 447 bp, Homo sapiens
  misc_feature: NA.52.13.B02.1.454.light.4.zerom50
tccgcggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccaggagtgatattggtggtcataactatgtctcctggtaccagcagctcccaggcaaagcccccaaactcatgatttttgatgtcaataagcggccctcaggggtccctgatcgcttctctggctccaagtctggcaacacggcctccctgaccatctctgggctccaggctgaggatgaggctgattattactgctgttcatttgcaggcatgtacacttatgtcttcggaagtgggaccagcgtcaccgtcctaagtcagcccaac

SEQ ID NO: 788611 - DNA, 445 bp, Homo sapiens
  misc_feature: NA.19.5.A05.1.454.light.4.zerom50
aggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggccctgggactaaggtggagatcagacgaactgtggctgcaccatctgtcttctac

SEQ ID NO: 788612 - DNA, 451 bp, Homo sapiens
  misc_feature: NA.17.53.E09.1.454.light.4.zerom50
ttgggtttgggggagctgctcagttaggacccagagggaaccatggaaaccccagcgcagcttctcttcctcctgctactctggctcccagatgtcaccggagaagttgtgttgacgcagtctccagccaccctgtctttgtctccaggggaaaagccaccctctcctgctgggccagccagtatgtcagcagtgataatttagcctggtatcagcaaaaacatggccaggctcccaggctcctcatctttggtgcatccagcaggatcactggcgtccctgacaggttcagaggcagggggtctgggacagacttcactctcaccatcaacagactggagcctgaagattttgcaatttattattgtcagcagtatggttcctcaccatctttcggcggagggaccagggtggagatgaatcgaactgtggctgcaccatctgtcttcta

SEQ ID NO: 788613 - DNA, 478 bp, Homo sapiens
  misc_feature: NA.43.18.B07.1.454.light.4.zerom50
aaggaggaaagggggaaggaggaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaaggctgaccgtcctaggtcagcccaaggcctgccccctcggtcta

SEQ ID NO: 788614 - DNA, 461 bp, Homo sapiens
  misc_feature: NA.52.47.E03.1.454.light.4.zerom50
agagagaagggggatcaggactcctcagttcaccttctcacaatgaggctccctgctcagctcctggggctgctaatgctctgggtcccaggatcaagtggggatgttgtgatgactcagtctccactctccctgcccgtcacccttggacagccggcctccatctcctgcaagtctagtgaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatggttggggtttattactgcatgcaaggtacacactggcctccgatcactttcggccaagggacacgactggagattaaacgaactgtggctgcaccta

SEQ ID NO: 788615 - DNA, 425 bp, Homo sapiens
  misc_feature: NA.4.32.C10.1.454.light.4.zerom50
caggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctccttatctctgatgcctccactttgcacggtggcgtcccaccaacgttcagcggcagtggatctgggacagaattcactctcaccatcagcagcctgcagcctgatgatgttgcaacttattactgtcaacaatataacaattattggacgttcggccaagggaccaaggtaggaaatacaaacgaactgtrgt

SEQ ID NO: 788616 - DNA, 448 bp, Homo sapiens
  misc_feature: NA.16.2.A02.1.454.light.4.zerom50
agggggaggaactgctcagttaggacccagagggaaccatggaagccccagctcagcttctcttcctcctgctactctggctcccagataccaccggagaaattgtgttgacacagtctccagccaccctgtctttgtctcccggggaaagagccaccctctcctgcagggccagtcagagtgttagcagcttcttagcctggtaccagcagagacctggccaggctcccagactcctcatctatgatgcatccaacagggccactggcatcccagccaggttcagtggcagtgggtctgggacagacttcactctcaccatcagcagcctagagcctgaagattctgcaatttattactgtcagcagagtaacaactggcctccgctcactttcggcggagggaccaaggtggagatcgaacgaactgtggctgcaccatctgtctt

SEQ ID NO: 788617 - DNA, 364 bp, Homo sapiens
  misc_feature: NA.7.27.C05.1.454.light.4.zerom50
agggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcagcccaaggctgccccctcggtcactctgttcccaccctcctctagagacacg

SEQ ID NO: 788618 - DNA, 446 bp, Homo sapiens
  misc_feature: NA.51.3.A03.1.454.light.4.zerom50
agggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttatttataaagactttgagaggccctcagggacccctgagcgattctctggctccagctcagcgacaacagtcacgttgaccatcagtggagtccaggcagaggacgaggctgactattactgtcagtcatcagacagcagtggcacttatgtcgtattcggcggagggaccaaactgaccgtcctaggtcagcccaaggctgccccctccc

SEQ ID NO: 788619 - DNA, 433 bp, Homo sapiens
  misc_feature: NA.47.28.C06.1.454.light.4.zerom50
actgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaa

SEQ ID NO: 788620 - DNA, 478 bp, Homo sapiens
  misc_feature: NA.52.54.E10.1.454.light.4.zerom50
aacacacaaaggggctgaacacacaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtctacc

SEQ ID NO: 788621 - DNA, 456 bp, Homo sapiens
  misc_feature: NA.47.79.H02.1.454.light.4.zerom50
agggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcaggtggatctgggacagatttcactctcaccatcagcagtctgcaacctgaagtattttgcaacttactactgtcaacagagttacggtaccccgtactacttttggccgtaggggaccaaacgtcggaacactcaaacgaactgtggctgcaccatctgtt

SEQ ID NO: 788622 - DNA, 429 bp, Homo sapiens
  misc_feature: NA.19.74.G08.1.454.light.4.zerom50
agggtgctgctaatgctctgggcccctggatccagtggggatattgtgatgacccaggctccactctcctcacctgtcacccttggacagccggcctccatctcctgcacttctagccaaaacctcgtgcacagtgatggaaacacctacttgagttggcttcagcagaggccaggccagcctccaagactcctaatctctaagatttctaaccggttctctggggtcccagacagattcagtggcagtggggcaggggcagatttcacactgagaatcagcagggtggaacctgaggatgtcgcgatttattactgcatgcaagctacacattttcctcgaacttttggccaggggaccaggctggagatcaagcgaactgtggctgcaccatctgtcttcatcttcccgccatctgacacgagagta

SEQ ID NO: 788623 - DNA, 465 bp, Homo sapiens
  misc_feature: NA.43.82.H05.1.454.light.4.zerom50
cagcttcagctgtgggtagagaagacaggactcaggacaatctccagcatggccagcttccctctcctcctcgccctcctcactcactgtgcagggtcctgggcccagtctgtcctgactcagccaccctcagcgtctgggacccccgggcagagggtcaccatctcttgttctggaagcagctccaacatcggaagtaatactgtaaactggtaccagcagctcccaggaacggcccccaaactcctcatctacagtattaatcagcggccctcagggatccctgaccgattctctggctccaagtctggcgcctcagcctccctggccatcagtgggctccagtctgaggatgaggctgattattactgtgctgcatgggatgacagcctgaatgcttgggtgttcggcggagggaccaagctgaccgtcctaggtcagaccccggctcrmcccctcggtcta

SEQ ID NO: 788624 - DNA, 446 bp, Homo sapiens
  misc_feature: NA.4.74.G08.1.454.light.4.zerom50
aagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccgaaggtaggaaatacaaacgaactagtggctgcacctaa

SEQ ID NO: 788625 - DNA, 513 bp, Homo sapiens
  misc_feature: NA.14.26.C04.1.454.light.4.zerom50
tacgatttgatgttacctgatgcttagaggcttttcctggaagcagggcatttgttgcttcagcaccgtagtgcctcgtcatcacgcctcagccttgattttccggattttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgcccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgctatgggttttacgcccccgttttcactcttcccgccatctgagtactagaccgtcg

SEQ ID NO: 788626 - DNA, 468 bp, Homo sapiens
  misc_feature: NA.15.56.F01.1.454.light.4.zerom50
tcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgccccctcggtcactctgttcccaccctcctcgctacgtagactgacgga

SEQ ID NO: 788627 - DNA, 456 bp, Homo sapiens
  misc_feature: NA.5.11.A11.1.454.light.4.zerom50
agaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttctgcatgcaaggtacacactggccgtacacttttggccaggggaccaagctggagatcaaacgaactgtggctgcacctattc

SEQ ID NO: 788628 - DNA, 455 bp, Homo sapiens
  misc_feature: NA.48.3.A03.1.454.light.4.zerom50
agggggagtcagacccagtcaggacacagcatggacatgagggtccccgctcagctcctggggctcctgctgctctggctcccaggtgccaagtgtgccatccagatgacccagtctccttccaccctgtctgcatctgtgggagacagcgtcaccatcacttgccgggccagtcagaatattaatgactggttggcctggtatcaacagaaaccagggaaagcccctaaacttctgatctttcaggcatctaatttagaacatggggtcccatcaaggttcagcggcagtgggtttggcacagacttcactctcaccatcgccagcctgcagcccgatgattttgcaacttatttctgccaacaatacaccactttgtggacgttcggccgggggaccgaacggtggagatcaagcgaactgtggctgcaccatctgtcttctatcttcccgta

SEQ ID NO: 788629 - DNA, 440 bp, Homo sapiens
  misc_feature: NA.40.32.C10.1.454.light.4.zerom50
aggaactgctcagttaggacccagagggaaccatggaagccccagctcagcttctcttcctcctgctactctggctcccagttatcaccggagacattgtattgacacagtctccagccaccctgtctttatctccgggggaaagagccaccttctcctgcagggccagtcagagtgttagcatctacttagcctggtaccaacaaagacctggccaggctcccaggctcctcatctatgatgcatccaccagggccactggcatcccagacaggttcagtggcagtgggtctgggacagacttcactctcaccatcagcagcctagagcctgaagattttggcgtttattactgtcagcagcgtgacagttggcctgcgcacagctttggccaggggaccaagctggaggtcaaacgaactgtggctgcacctactgtt

SEQ ID NO: 788630 - DNA, 450 bp, Homo sapiens
  misc_feature: NA.41.47.E03.1.454.light.4.zerom50
agagagaaggggtgatcaggactcctcagttcaccttctcacaatgaggctccctgctcagctcctggggctgctaatgctctgggtctctggatctagtggagagattgtgatgagtcagtctccacgctccctgtccgtcacccctggagagtcggcctccatctcctgcaagtcgagtcacaacctcctgtatagtaatggatacaattatgtggattggtacgtgcagaagccagggcagtctccacaactcctcatctatttgggttctcatcgggactccggggtccctgacaggttcactggcagtggatcaggcacagattttaccctagaaatcagtagagtggaggctgaggatgttggcgactattactgcctgcaagctcggcaattcccgatcaccttcggccccgggacacgactggacattaaacgaactgtggt

SEQ ID NO: 788631 - DNA, 477 bp, Homo sapiens
  misc_feature: NA.8.88.H11.1.454.light.4.zerom50
aacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgccactcg

SEQ ID NO: 788632 - DNA, 459 bp, Homo sapiens
  misc_feature: NA.40.39.D06.1.454.light.4.zerom50
cagttctttggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 788633 - DNA, 439 bp, Homo sapiens
  misc_feature: NA.47.46.E02.1.454.light.4.zerom50
aggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgctagtttattactgtcagcagtatcataactggccgctcaccttcggccaagggacacgactggagattaaacgaactgtggctgcaccatctgtyg

SEQ ID NO: 788634 - DNA, 456 bp, Homo sapiens
  misc_feature: NA.3.86.H09.1.454.light.4.zerom50
ttkgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtctccatcacttgccgggccagtcagagtattagtcgctggttggcctggtatcagcagaaaccagggaaagcccctaagctcctgatctatcaggcgtctagtttacaaagtggggtcccatcaaggttcagcggcagtggatctgggacagaattcactctcaccatcagcagcctgcagcctgatgatttttgctaacttattactgccaacagtataatacttattggacgttcggccaagggaaccgaaggtaggaaatacaaaacgaactagtggctgcaccatctgtctt

SEQ ID NO: 788635 - DNA, 444 bp, Homo sapiens
  misc_feature: NA.4.82.H05.1.454.light.4.zerom50
actgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacactgatggaaacacctacttgaattggtttcagcagaggccaggccaatctccaaggcgcctaatttataaggtttctaaccgggactctggggtcccagacagattcagcggcagtgggtcaggcactgattacacactgagaatcagcagggtggaggctgaggatgttggggtttattactgcatgcaagggacacactggccgtacacttttggccaggggaccaagctggagatcaaacgaactgtggctgca

SEQ ID NO: 788636 - DNA, 442 bp, Homo sapiens
  misc_feature: NA.10.32.C10.1.454.light.4.zerom50
caggagtcagtctcagtcaggacacagcatggacatgagggtccccgctcagctcctggggctcctgctactctggctccgaggtgccagatgtgacatcccagatgacccagtctccaccgtccctgtctgcatttgtaggagacagagtcaccatctcttgccgggcaagtcagaacattgacacttatttaaattggtatcaacaaaaactggggaaagcccctacactcctgatcaatgctgcgtccagtttacagagtggggtcccatcaaggttcagtggcagtggatctgggacagactttactctcaccatcagcgatctgcagcctgacgattttgcgacttactactgtcaacagtagtttccggaaccccgttactttcggcggagggaccgaaggtggagatcaaacgaactgtggctgcaccatctgtt

SEQ ID NO: 788637 - DNA, 462 bp, Homo sapiens
  misc_feature: NA.51.50.E06.1.454.light.4.zerom50
agctgtgggctcagaagcagagttctggggtgtctccaccatggcctggacccctctctggctcactctcctcactctttgcataggttctgtggtttcctctgagctgactcaggaccccgctgtatctgtggccttgggacagacagtcaggatcacatgccaaggagacagcctcacaagttattatgcaggctggtaccagcagaagccaggacaagcccctatacttgtcctctatggtaataatcaccggccctcagggatcccagaccgattctctggctccagctcaggaaacacagcttccttgaccatcactggggctcaggcggaagatgaggctgactactactgtaattcccgggacaccagtggtcatagtggaaaccgggtcgtgttcggcggagggaccaaggtgaccgtcctgggtcagcccaaggctgccccctccgtcctacc

SEQ ID NO: 788638 - DNA, 456 bp, Homo sapiens
  misc_feature: NA.53.42.D09.1.454.light.4.zerom50
agggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactcc

SEQ ID NO: 788639 - DNA, 457 bp, Homo sapiens
  misc_feature: NA.26.30.C08.1.454.light.4.zerom50
aagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagtattttgctagtttattactagtcagcagtatcatgactggccgcctcaccytcgkccgaacggracgacgaackkgagaktwaacgaaacgtaagtrgstgcaccat

SEQ ID NO: 788640 - DNA, 454 bp, Homo sapiens
  misc_feature: NA.26.11.A11.1.454.light.4.zerom50
gagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagacgaactgtggctgcaccatctgtcttcatcttcccg

SEQ ID NO: 788641 - DNA, 436 bp, Homo sapiens
  misc_feature: NA.53.7.A07.1.454.light.4.zerom50
aggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcacgttatgatgtacactggtaccagcaccttccaggagcacgcccccaacctcctcctctctggtaacaccaatccggccctcacggggtccctgaccgattctctggctcgaagtctggcacctcagcctccctggccatcactggcctccaggctgaggatgaggctgattattactgccagtcctatgacagcagcctgaatgcttatgtcttcggaactgggacctaa

SEQ ID NO: 788642 - DNA, 465 bp, Homo sapiens
  misc_feature: NA.53.24.C02.1.454.light.4.zerom50
tagggaaagggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatgtcctgcactgggaccagttccaacatcggggcagattatgatctacactggtatcagcaagttccaggaaccgcccccaaactcctcatctatggtaacaccaatcgaccctcaggggtccctgaccgattctctgcctccaagtctggcacctcagcctccctggccatcactgggctccagcctgaggatgaggctatttattactgccagtcctatgacaccagcctgagtggatcggtgttcggcggagggaccaaactgaccgtcctacgtcagaccccg

SEQ ID NO: 788643 - DNA, 474 bp, Homo sapiens
  misc_feature: NA.12.3.A03.1.454.light.4.zerom50
agagaggaagggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctggaccgtcctaggtcagcccaaggcacgccccctcggtcacttcg

SEQ ID NO: 788644 - DNA, 435 bp, Homo sapiens
  misc_feature: NA.7.12.B01.1.454.light.4.zerom50
tcacgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgaagtgcatatgaagagaactgtggctgca

SEQ ID NO: 788645 - DNA, 451 bp, Homo sapiens
  misc_feature: NA.10.68.G02.1.454.light.4.zerom50
tgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattctccggctccagctcagggacagtggcctccttgactatcagtggggcccagggggtcgatgaggctgactactactgtttctcgactgacttcactggtaaacgttggctgttcggcggagggaccaagctgaccgtcctgcgtcagcccaaggctgccccctcggtcacttccg

SEQ ID NO: 788646 - DNA, 480 bp, Homo sapiens
  misc_feature: NA.51.58.F03.1.454.light.4.zerom50
aaagggaaagggggaactgagctacaacaggcaggcaggggcagcaagatggtgttgcagacccaggtcttcatttctctgttgctctggatctctggtgcctacggggacatcgtgatgacccagtctccagagtccctggctgtgtctctgggcgagagggccaccatcacctgcaagtccagccagagtgttttatacagcggcaacaataagaattacttagcttggcaccagcagaaactaggacagcctcctaagttgctcatctcctgggcatctacccgggaatccggggtccctgaccgattcagtggcagcgggtctgggacagatttcactctcaccatcaacaacctgcaggctgaggatgtggcagtttattactgtcagcaatattacagtactcttccgatcaccttcggccaagggacgcgactggagattaaacgaactgtggctgcaccatctgtcttcatt

SEQ ID NO: 788647 - DNA, 490 bp, Homo sapiens
  misc_feature: NA.43.1.A01.1.454.light.4.zerom50
argggggggggaggggcagtttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcttgttctggaagcagttccaacatcggaagtaataatgtgaattggtaccggcaactcccaggaacggcccccaaactcctcatgcatagtaatgatcatcggcccccaggggtccctgaccgaatctctggctccaggtctggcgcctcagcctccctggtcatcagtgggctccaatctgaggatgaggctgactattactgttcagcgtgggatgccagcccgaatgggttgggtgttcgggcggagggaccaaactgaccgtcctacggtcagcccaagggcctcgccccctcggtcacbttc

SEQ ID NO: 788648 - DNA, 508 bp, Homo sapiens
  misc_feature: NA.10.57.F02.1.454.light.4.zerom50
ttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttagccccgtttcatccttcccgccatctgacactaa

SEQ ID NO: 788649 - DNA, 436 bp, Homo sapiens
  misc_feature: NA.43.50.E06.1.454.light.4.zerom50
caggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggacctatctaaattggtatcagcagaaaccagggaaagtccctgaggtcctcatctatggtgcatccagtttgccaagtggggtcccagcaaggttcagtggcagtggatctgggacagatttcactctcaccatcagcagtctacaacctgaagattttgcaacttactactgtcaacagagtttcagtacccctctgacgttcggccaagggaccaaggtggaaataaaacgaactagtggctgcaccatt

SEQ ID NO: 788650 - DNA, 448 bp, Homo sapiens
  misc_feature: NA.43.43.D10.1.454.light.4.zerom50
argggggagtcagacccactcaggacacagcatggacatgagggtccccgctcagctcctggggctcctgctgctctggctcccaggtgccagatgtgccatccagatgacccagtctccttcctccctgtctgtgtctgtaggagacaaagtcaccatcacttgccgggcaagtcaggacattagagatgaattagcctggtatcagcagaaaccagggaaagcccctaagctcctgatctatgctgcatccattttacaaaatggggtcccgccaagattcagcggcagtggatctggcacagatttcactctcaccgtcagcagcctgcagtctgaagattttgcaacttattactgtctacaagattataaataccctcggacgttcggccgaggggaccgaaggtaggagtgtcaagcgaacttgtggctgcaccatctgttt

SEQ ID NO: 788651 - DNA, 461 bp, Homo sapiens
  misc_feature: NA.9.57.F02.1.454.light.4.zerom50
ttgggtttgggggctctgcttcagctgtgggcacaagaggcagcactcaggacaatctccagcatggcctggtctcctctcctcctcactctcctcgctcactgcacagggtcctggggccagtctgtcctgacgcagccggcctcagtatctgggtccccagggcagagggtcaccatctcctgcactgcgaacagctccgacgtcgcgacaccttatattgtacactggtatcaagtacttccagggacagcccccagactcctcatctattctaacaccttccgaccctcaggggttcctgaccgattctctggctcccagtctggcacctcagcctccctggccgtcactgggctccagtctgaggatgaggctgattattactgccagtcctacgacactttcctgagtctttgggtgttcggcggagggaccaagctgaccgtccttcgtctacg

SEQ ID NO: 788652 - DNA, 446 bp, Homo sapiens
  misc_feature: NA.10.50.E06.1.454.light.4.zerom50
tctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcataattcatgatgtcaataatcggccctcaggggtttctaatcgcttctctggcttcaagtctggcaacacggcctccctgaccatctctgggctccaggctgaggacgaggctgattattactgcagctcatatacaaccagcagcactcgggtgttcggcggagggaccaagctgaccgtcctaggtcagcccaaggcctgtccccccg

SEQ ID NO: 788653 - DNA, 437 bp, Homo sapiens
  misc_feature: NA.52.49.E05.1.454.light.4.zerom50
aacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctccatacacttttggccaggggaccaagctggagatcagaacgaactc

SEQ ID NO: 788654 - DNA, 436 bp, Homo sapiens
  misc_feature: NA.4.63.F08.1.454.light.4.zerom50
aaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgtacaagtcagagcattaacatctatttaaattggtatcagcagcaatcagggaaagcccctaaactcctgatctatgatggatccactttggaacatggggtcccttcaaggttcagtggcagtggatctgggacagagttcactctcaccatcagccgtctgcaacctgaagattttgcaacttactactgtcaacagagttacaatctcccgctcactttcggcggagggacgaaggtggagatcaaacgaactgtggctgcacc

SEQ ID NO: 788655 - DNA, 453 bp, Homo sapiens
  misc_feature: NA.9.1.A01.1.454.light.4.zerom50
agggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 788656 - DNA, 329 bp, Homo sapiens; identical to SEQ ID NO: 787528
  misc_feature: NA.41.78.H01.2.454.light.4.zerom50

SEQ ID NO: 788657 - DNA, 449 bp, Homo sapiens
  misc_feature: NA.40.29.C07.1.454.light.4.zerom50
agggaaagggggagtcagacccagtcaggacacagcatggacatgagggtccccgctcagctcctggggctcctgctgctctggctcccaggtaccaagtgtgacatccagatgacccagtctccctccgccctgtctgcatctgtaggagacagagtcaccataatctgccgggccagtcagactgttaataggtggttggcctggtatcagcagaaacctgggaaagcccctagcctcctgatctctgagacatctatcttacaaactggggtcccagccaggttcagcggcagtgtttctgggacagacttcagtctcaccatcagcagcctacagcctgatgattctgcaacttattggtgccaacaatataacagttatccgtacactttcggccaggggactaagctggagatcaaacgaactgtggctgcaccatctgtctt

SEQ ID NO: 788658 - DNA, 476 bp, Homo sapiens
  misc_feature: NA.53.21.B10.1.454.light.4.zerom50
aagagaggaggggggtctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcggcggagggaccaagctgaccgtcctaggtcagcccaaggctcgccccctcggtcactctgttcccccg

SEQ ID NO: 788659 - DNA, 450 bp, Homo sapiens
  misc_feature: NA.43.78.H01.2.454.light.4.zerom50
actgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttggggtttattactgcatgcaaggtacacactggcccgtcaccttcggccaagggacacgactggagattaaacgaactgtggctgcacctatt

SEQ ID NO: 788660 - DNA, 447 bp, Homo sapiens
  misc_feature: NA.40.70.G04.1.454.light.4.zerom50
agctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccggagtgttttgtacagctccaacaataagaattacttagcttggtatcagcagagaccagggcagcctcctaagttgctcatttactgggcatctacccgggaatccggggtccctgaccgattcagtggcagcgggtctgggacagatttcactctcaccatcagcagcctgcaggctgaagatgtggcactttattactgtcagcaatattttagtattccgttcactttcggcggagggaccaaggtggagatcaaacgaactgtggctgcaccta

SEQ ID NO: 788661 - DNA, 461 bp, Homo sapiens
  misc_feature: NA.49.79.H02.2.454.light.4.zerom50
agggaaaggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaaggcccccaaactcttcatttatgatgtcactaatcggccctcaggggtccctgatcgcttctctgcctccaagtctggcaacacggcctccctgaccatctctgggctccaggctgaggatgaggctcattattattgttgctcatatgcaggcaacttcgcttttgtcttcggaactgggaccgaggtcaccgtcctgggtcagcccaaggcccaacccca

SEQ ID NO: 788662 - DNA, 439 bp, Homo sapiens
  misc_feature: NA.52.70.G04.1.454.light.4.zerom50
aagagctgctcagttaggacccagagggaaccatggaaaccccagcgcagcttctcttcctcctgctactctggctcccagatatcaccggggaaattgtgttgacgcagtctccaggcaccctgtctttgtctccaggggaaagagtcaccctctcctgcagggccagtcagagtgttctcgccagctacttagcctggtaccagcagaaacctggccaggctcccaggctcctcatctatgcttcatccagcagggccgctggcatcccagacaggttcagtggcagtgggtctgggacagacttcactctgaccatccgcagactggagcctgaagattttgcggtgtattattgtcagcactatgatacctcactcatgtacacttttggccaggggaccaagctggagatcaaacgaactgtggctgcaccatt

SEQ ID NO: 788663 - DNA, 431 bp, Homo sapiens
  misc_feature: NA.13.50.E06.2.454.light.4.zerom50
aggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacgactggagattaaaggaactgtggctgcaccattc

SEQ ID NO: 788664 - DNA, 487 bp, Homo sapiens
  misc_feature: NA.49.26.C04.2.454.light.4.zerom50
ctgtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctcggtcactctcgttcccaccctcctctctcyckmctccttcccg

SEQ ID NO: 788665 - DNA, 447 bp, Homo sapiens
  misc_feature: NA.43.44.D11.1.454.light.4.zerom50
aagggggggtcagacccagtcaggacacaacatgcacatgagggtccccgctcagctcctggggctcctgctgctctggctcccaggtgcccaatgtgacatccaggtgacccagtctccttccaccctgtctgcatctgtcggagacagagtcaccatctcttgccgggccagtcaaagttctgtcaggtggttggcctggtatcagcagaagtcagggcaagcccctaggctcctgatgtttaaggcgtctggttcagagagtgaggccccgtccaggttctctgccagtggatctggaacagaactcacactcatcatccgcagcctgcagcctgatgactttgcaacatattactgccaagagtttgatggtcgtttgtggacgttcggccaagggaccagggtagacgtcaaacgaactgtggctgcaccatctgtcttcta

SEQ ID NO: 788666 - DNA, 475 bp, Homo sapiens
  misc_feature: NA.53.41.D08.1.454.light.4.zerom50
agtctgggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaaagtgtgcactggtaccagcagatgccaggccaggcccctgtgttggtcgtctatgatgatagcgaccggccctcaggggtccctgagcgattctctggctccaactctgggaacacggccaccctgaccataagcagggtcgaagccggggatgaggccgactattactgtcaggtgtgggatactagtagtgatcatccttgggtgttcggcggtgggaccaggctgaccgtcctaggtcagcccaaggctgccccctcggtcactctcgttcccrccctcctctcg

SEQ ID NO: 788667 - DNA, 428 bp, Homo sapiens
  misc_feature: NA.40.61.F06.1.454.light.4.zerom50
cagtcaggacacagcatggacatgagagtcctcgctcagctcctggggctcctgctgctctgtttcccaggtgccagatgtgacatccagatgacccagtctccatcctcactgtctgcatctgtaggagacagagtcaccatcacttgtcgggcgagtcaagacattagcaactacttagcctggtttcagcagaaaccagggaaagcccctaagtccctgatctctgctgcatccaatttgcaaagtggggtcccatcgagattcagcggcagtggatctggaacaaatttcactctcaccatcaacagcctgcagactggagattttggaacttattactgccaacattataatactttccctctcactttcggcggagggaccacggtggagatcagacgaactgtggctgcaccatctgtctt

SEQ ID NO: 788668 - DNA, 445 bp, Homo sapiens
  misc_feature: NA.43.72.G06.1.454.light.4.zerom50
ctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtcctaggtcagcccaaggctgccccctcggtcctaccg

SEQ ID NO: 788669 - DNA, 444 bp, Homo sapiens
  misc_feature: NA.41.22.B11.2.454.light.4.zerom50
agggggaatcagacccagtcaggacacagcatggacatgagagtcctcgctcagctcctggggctcctgctgctctgtttcccaggtgccagatgtgacatccagatgacccagtctccatcctcactgtctgcatctgtacgagacagagtcaccatcacttgtcgggcgagtcaggtcattagcaattctttagcctggtttcagcagaaaccagggaaagcccctaagtccctgatccatagtgcttccagtttgcagagtggggtcccattaaagttcagcggcaatggatttgggacacatttcagtctcaccatcagcagcctacagcctgaagattgtgcaacttattactgccaacagtattttacttacccttggacgttcggccaagggaccaaggtggaaatcaatcgaactgtggctgcaccatctgtcttt

SEQ ID NO: 788670 - DNA, 485 bp, Homo sapiens
  misc_feature: NA.13.36.D03.4.454.light.4.zerom50
atctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctcgggctccaactctgggaacacggccactctgaccatcagtagggtcgaagccggggatgaggccgactattactgtcaggtgtgggatagtagtcgtgagcatgtggtattcggcggagggaccaaactgaccgtcctaggtcagcccaaggctcgccccctcggtcactctgttcccccgtcctctacg

SEQ ID NO: 788671 - DNA, 437 bp, Homo sapiens; identical to SEQ ID NO: 788239
  misc_feature: NA.51.72.G06.1.454.light.4.zerom50

SEQ ID NO: 788672 - DNA, 341 bp, Homo sapiens
  misc_feature: NA.41.27.C05.3.454.light.4.zerom50
agggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 788673 - DNA, 452 bp, Homo sapiens
  misc_feature: NA.52.43.D10.1.454.light.4.zerom50
aagggggaggaactgctcagttaggacccagacggaaccatggaagccccagcgcagcttctcttcctcctgctactctggctcccagattctactgaagaaatagtgatgacgcagtctccagccaccctgtctgtgtctccaggggaagcagtcaccctctcctgcagggccagtcagactgttaacaccaacttagcctggtaccagcacaaacctggccgggctcccaggctcctcatctatggtgcatccaccagggccactggtgtcccagccaggttcagtggcagtgggtctgggacagagttcactctcaccatcagcagcctgcagtctgaagattttgcagtttattactgtcagcagtatcataactgggtcctcttcactttcggccctgggaccaaggtggatatcaaacgaactgtggctgcaccatctgtcttcta

SEQ ID NO: 788674 - DNA, 445 bp, Homo sapiens
  misc_feature: NA.51.24.C02.2.454.light.4.zerom50
tagggaaagggggggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagcccaaggctgccccctc

SEQ ID NO: 788675 - DNA, 440 bp, Homo sapiens
  misc_feature: NA.52.25.C03.1.454.light.4.zerom50
agtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaacaccttaatagttactccttcactttcggccctgggaccaaagtggacatcaaacgaactgtggctgcaccatctgtcttcta

SEQ ID NO: 788676 - DNA, 373 bp, Homo sapiens
  misc_feature: NA.41.82.H05.2.454.light.4.zerom50
cacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 788677 - DNA, 460 bp, Homo sapiens
  misc_feature: NA.26.72.G06.1.454.light.4.zerom50
cagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagacgaactgtggctgcaccatctgtcttcatcttcccgaaagtaatgaaagttaac

SEQ ID NO: 788678 - DNA, 476 bp, Homo sapiens
  misc_feature: NA.48.45.E01.1.454.light.4.zerom50
tggtctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctcgccccctcggtcactctcgttcccacccttct

SEQ ID NO: 788679 - DNA, 483 bp, Homo sapiens
  misc_feature: NA.51.66.F11.2.454.light.4.zerom50
agggaaagggggaggaactgctcagtcaggacccagacggaaccatggaagccccagcgcagcttctcttcctcctgctactctggctcmsrgawagskactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccaaggtggaaatgaaaggaactgtggctgcaccatctgtcttcatcttcccgccatctgatcgtagcact

SEQ ID NO: 788680 - DNA, 446 bp, Homo sapiens
  misc_feature: NA.15.81.H04.1.454.light.4.zerom50
tctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctgccccctcct

SEQ ID NO: 788681 - DNA, 477 bp, Homo sapiens
  misc_feature: NA.53.6.A06.1.454.light.4.zerom50
aggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggaaagtcggccagatttacctgtgagggaaggcacattgaaactaaaagtgtgcactggtaccagaagaagccaggccaggcccctgtggtggtcgtctatgatgatagcgaccggccctcagggatccctgagcgattctctggctccagctctgggaacacggccaccctgaccatccacagggtcgaatccggggatgaggccgactatttttgtcaggtgtgggatagccttagtgaccaaccggtgttcggcggagggaccaagctggccgtcctaggtcagcccaaggctgccccctcggtcactctgttcccrccctcctctcgtact

SEQ ID NO: 788682 - DNA, 465 bp, Homo sapiens
  misc_feature: NA.12.12.B01.2.454.light.4.zerom50
tccgcgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagctgcattgccaataaaatctccttattggtaccagcagaagtcaggccaggcccctgtattggtcatctatgaggacaacagacgaccttccgggatccctgagagattctctggctccacctcagggacaatggccaccttgactatcagtggcgcccaggtggaggatgaggctgactactattgttattcaacagacagcactacaagtcattgggtgttcggcggagggaccaagctgaccgtcctacgtcagcccaaggctgccccctcggtcactctgttccccg

SEQ ID NO: 788683 - DNA, 459 bp, Homo sapiens
  misc_feature: NA.52.79.H02.1.454.light.4.zerom50
agggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgmtatgcttattggtaccagcagaagccaggccaggcccctgtgttggtgatatataaagacactgagaggccctcagggatccctgagcgattctctggctccacctcagggacaatggtcacattgaccatcagtggagtccaggcagaggacgaggctgactattactgtcaatcaacagacaycagtggtacttatgtcttcggaactgggaccaaggtcaccgtcctaggtcagcccaaggccaaccccactgtcactcttcg

SEQ ID NO: 788684 - DNA, 481 bp, Homo sapiens
  misc_feature: NA.43.45.E01.1.454.light.4.zerom50
ctgggcctgaggaagcagcactggtggtgcctcagccatggcctggaccgttctcctcctcggcctcctctctcactgcacaggctccgtgacctcctatgaactgactcagcccccctcggtgtctgtggccccaggacagacggccagcattacctgtgggggatacaactttgcccagaaaaatgtacattggtatcagcagaaggcaggccaggcccctgtgatggtcgtctgtgacgatagggaccggccctcggggatccttgagcgattctctggctccaagtctgggaacacggccactctgaccatcagccgggtcgaggccggggacgaggccgactattattgtcaactgtgggatggtactggtgaccggtactgggtgttcggcggagggaccaagctgaccgtcctaggtcagcccaaggctgccccctcggtcactctgttcccgccctcctcactactcataacc

SEQ ID NO: 788685 - DNA, 457 bp, Homo sapiens
  misc_feature: NA.48.76.G10.1.454.light.4.zerom50
aaggggagtcagacccagtcaggacacagcatggacatgagggtccccgctcagctcctggggctcctgctgctctggctcccaggtgccaaatgtgacatccagatgacccagtttccttccaccctgtctacatttgtgggagacagagtcagtatcagttgccgggccagtcagagtattactaggtggttggcctggtatcagcagagaccagggaaagcccctaagctcctaatccaagaggcatccaccttagaagttggggtcccgtcacggttcagcggcagcgggtctgggacagcgttcactctcaccatcagcggcctgcagtctgatgattttgcaacttattactgccaacagtatagtacttatccgtacacttttggccaggggaccaagctggagatcaaacgaactgtggctgcaccatctgtcttcatcttcccgccta

SEQ ID NO: 788686 - DNA, 472 bp, Homo sapiens
  misc_feature: NA.48.21.B10.1.454.light.4.zerom50
aagagaggagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttcccgccta

SEQ ID NO: 788687 - DNA, 450 bp, Homo sapiens
  misc_feature: NA.52.68.G02.2.454.light.4.zerom50
ctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgcttctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcactctccg

SEQ ID NO: 788688 - DNA, 435 bp, Homo sapiens
  misc_feature: NA.47.45.E01.2.454.light.4.zerom50
agtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgtt

SEQ ID NO: 788689 - DNA, 446 bp, Homo sapiens
  misc_feature: NA.3.25.C03.1.454.light.4.zerom50
aagtcagactcagtcaggacacagcatggacatgagggtccccgctcagctcctggggctcctgctgctctggctcccaggtgccgagggtgacatccagctgacccagtctccctccaccgtgtctgcattcgtaggagacagagtcaccatcacctgtcgggccagtcagagtattaatagttggttggcctggtatcaccagagaccaggtgaagccccaaaactccttatttatgatgcctccactttgaatagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaactgtggctgcaccatctgtcttcatcttccccg

SEQ ID NO: 788690 - DNA, 502 bp, Homo sapiens
  misc_feature: NA.13.81.H04.2.454.light.4.zerom50
taagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctccgwwcggacccggaaccccctaacccctaccgacctacctaccttcccg

SEQ ID NO: 788691 - DNA, 307 bp, Homo sapiens
  misc_feature: NA.19.26.C04.1.454.light.4.zerom50
tgtggtggtctccactcccgccttgacggggctgttatctgccttccaggcccctatactggtcatctattataataccgtccggccctcagggatccctgagcgactctctggctccaactctgggaacacggccaccctgaccgtcagcagggtcgaagccggggatgaggccgactattactgtcaggtgtgggatagtagtagcggtcatgtgattttcggcggagggaccaagctgaccgtcctaggtcagcccaaggctgccccctcggtcactctgttcccgccctcctccacgagagta

SEQ ID NO: 788692 - DNA, 450 bp, Homo sapiens
  misc_feature: NA.13.73.G07.1.454.light.4.zerom50
agggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaactgtggctgcaa

SEQ ID NO: 788693 - DNA, 333 bp, Homo sapiens
  misc_feature: NA.48.25.C03.5.454.light.4.multim50
agctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctcttttactgggcgtcttcccgggagtccggggtccctgaccgattcagtgccaggcgggtctgggacagtacttcactctcacca

SEQ ID NO: 788694 - DNA, 462 bp, Homo sapiens
  misc_feature: NA.43.35.D02.5.454.light.4.multim50
ttkgggtttggggtcagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagtcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttggggtgttcggcggagggaccargstgaccgtcctaggtcagccccg

SEQ ID NO: 788695 - DNA, 469 bp, Homo sapiens
  misc_feature: NA.48.38.D05.5.454.light.4.multim50
ttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaagggtggacatacaaacgaactgtggctgcaccatctgtcttcatcttccccgccta

SEQ ID NO: 788696 - DNA, 456 bp, Homo sapiens
  misc_feature: NA.52.34.D01.5.454.light.4.multim50
tttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactc

SEQ ID NO: 788697 - DNA, 438 bp, Homo sapiens
  misc_feature: NA.49.68.G02.2.454.light.4.multim50
tgatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgttgggatttattactgcatgcaagctctacaagctcctcagctcactttcggcggagggaccaaggtggagatacaaacgtaacg

SEQ ID NO: 788698 - DNA, 480 bp, Homo sapiens
  misc_feature: NA.49.82.H05.2.454.light.4.multim50
cacgaccggtgctcgatttagtcgagctctctcgcgggcacgaccggtgctcgatttagtagtagtagattcgmggggagtcagtcccaaccaggacacagcatggacatgagggtccctgctcagctcctggggctcctgctgctctggctctcaggtgccagatgtgwcatccagatgacccagtctccwtcctccctgtctgcatctataggagacagaatcaccatcacttgccgggcgagtcgagaacattagcatgtatctgaattggtatcagacaaaaaccagggacagcccctaaamtcctgatcctcgatgcatccactttggaracaggggtcccatcaaggttcagtggaagtggctctgggacagtattttactttctaccatcagcaggctgcagcctgaagatattgctaacatattactgtcaacagtatgatagtctcccgctcactttcggcgggggtaccg

SEQ ID NO: 788699 - DNA, 459 bp, Homo sapiens
  misc_feature: NA.49.45.E01.8.454.light.4.multim50
catgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagtactttcggccaagggaccaaggtaggaaatacaaaacgaactgtggctgcaccatctgttcttctactccttccccgccat

SEQ ID NO: 788700 - DNA, 491 bp, Homo sapiens
  misc_feature: NA.48.34.D01.9.454.light.4.multim50
ttgggtttggggcagcttcagctgtggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactcccggtccgaggatgagggtgwwttttattgtgctgtttgggatgacgacatgaatggttcgtagttttcgggcggagggaccaaacgtgacccgtccgtgggtcacgcccgaaggcctcgccccctcggtcactctcg

SEQ ID NO: 788701 - DNA, 463 bp, Homo sapiens
  misc_feature: NA.48.86.H09.2.454.light.4.multim50
ttgggtttgggggagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 788702 - DNA, 464 bp, Homo sapiens
  misc_feature: NA.51.27.C05.3.454.light.4.multim50
agggtttgggggaggaactgctcagttaggacccagagggaaccatggaagccccagctcagcttctcttcctcctgctactctggctcccagattccaccggagaaattgtgttgacacagtctccaggcaccctgtctttgtctccaggggaaagagccaccctctcctgcagggccagtcagagtgttagtcacttcttagcctggtaccaacacaaacctggccaggctcccaggctcctcatytatgatgcatccamgagggccactgryrtcccagccaggttcagtggcagtgggtctgggacagacttcactctcaccatcagcagcctrsagyctgaagattttgcaatttattactgtcagcagyrtaryaattggcctccstcgaycacyttcggccaagggaccamgrctggagatcaaacgaactgtggctgcaccatctgtcttcattcc

SEQ ID NO: 788703 - DNA, 433 bp, Homo sapiens
  misc_feature: NA.48.15.B04.2.454.light.4.multim50
tccgcgggcacgaccggtgctcgatttagmtcghbathgttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggttt

SEQ ID NO: 788704 - DNA, 490 bp, Homo sapiens
  misc_feature: NA.48.47.E03.1.454.light.4.multim50
agagagagaaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgttcagcagtatggaagttcacctcggacattcggccaggggaccaaggtggaaatcaaacgaactggtggctgcaccatctgtcttctatcttccccgccatctgatatgtatact

SEQ ID NO: 788705 - DNA, 449 bp, Homo sapiens
  misc_feature: NA.52.41.D08.2.454.light.4.multim50
ctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactcttcg

SEQ ID NO: 788706 - DNA, 448 bp, Homo sapiens
  misc_feature: NA.52.41.D08.3.454.light.4.multim50
aagagctgctcagttaggacccagagggaaccatggaaaccccagcgcagcttctcttcctcctgctactctggctcccagatatcaccggggaaattgtgttgacgcagtctccaggcaccctgtctttgtctccaggggaaagagtcaccctctcctgcagggccagtcagagtgttctcgccagctacttagcctggtaccagcagaaacctggccaggctcccaggctcctcatctatgcttcatccagcagggccgctggcatcccagacaggttcagtggcagtgggtctgggacagacttcactctgaccatccgcagactggagcctgaagattttgcggtgtattattgtcagcactatgatacctcactcatgtactackttttggccgtaggggaccaagcgtggagatacaaacgaactgtggctcgcaccattcg

SEQ ID NO: 788707 - DNA, 476 bp, Homo sapiens
  misc_feature: NA.52.41.D08.4.454.light.4.multim50
ctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaractgaccgtcctacgtcagcccaaggctgccccctcggtcactctgttcccaccctcctcta

SEQ ID NO: 788708 - DNA, 436 bp, Homo sapiens
  misc_feature: NA.52.41.D08.5.454.light.4.multim50
agtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaaacatattactgtcaactagtacgataatctcccgctcactttcggcgggggaccgaacggtaggagatcaaacgaactagtggctgcaccat

SEQ ID NO: 788709 - DNA, 497 bp, Homo sapiens
  misc_feature: NA.48.47.E03.2.454.light.4.multim50
agagagaagggcacgaccggtgctcgatttagwgagcrtcwcagagagaagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 788710 - DNA, 426 bp, Homo sapiens
  misc_feature: NA.48.47.E03.3.454.light.4.multim50
agagagaagggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 788711 - DNA, 339 bp, Homo sapiens
  misc_feature: NA.49.42.D09.2.454.light.4.multim50
agggaaaggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgaggtcaccgtcctgggtcagcccaaggccaaccccactgtcactctgttcccaccctcctctctctcgact

SEQ ID NO: 788712 - DNA, 463 bp, Homo sapiens
  misc_feature: NA.49.42.D09.3.454.light.4.multim50
agggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaaggcccccaaactcttcatttatgatgtcactaatcggccctcaggggtccctgatcgcttctctgcctccaagtctggcaacacggcctcctgaccatctctgggctccaggctgaggatgaggctcattattattgttgctcatatgcaggcaacttcgcttttgtcttcggaactgggaccgaggtcaccgtcctgggtcagcccaaggcccaacccctac

SEQ ID NO: 788713 - DNA, 451 bp, Homo sapiens
  misc_feature: NA.49.42.D09.4.454.light.4.multim50
agggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccggggaaggcccctaggttactgatctatgctgcagccaatttgcaaagtggggtccccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctcgtctt

SEQ ID NO: 788714 - DNA, 464 bp, Homo sapiens
  misc_feature: NA.48.67.G01.1.454.light.4.multim50
tttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 788715 - DNA, 531 bp, Homo sapiens
  misc_feature: NA.48.85.H08.1.454.light.4.multim50
tcgcgggcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgaccgtcctaggtcacggccaaggctgccccctcggtcactctgttcccgccctcctctatgtatact

SEQ ID NO: 788716 - DNA, 472 bp, Homo sapiens
  misc_feature: NA.48.85.H08.2.454.light.4.multim50
tcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcggggggaccgaggctgaccgtcggcggtcagcccaaggctcgccccctcggtcactctcgttccctaccctccctt

SEQ ID NO: 788717 - DNA, 457 bp, Homo sapiens
  misc_feature: NA.48.85.H08.3.454.light.4.multim50
tcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcggagggaccaagctgaccgtctaggtcagccaaggctgccccctc

SEQ ID NO: 788718 - DNA, 472 bp, Homo sapiens
  misc_feature: NA.48.67.G01.2.454.light.4.multim50
ttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctcgtccccccgaaccgaacggtccgtcccc

SEQ ID NO: 788719 - DNA, 456 bp, Homo sapiens
  misc_feature: NA.3.1.A01.2.454.light.4.multim50
aaggrarggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgctagtttattactgtcagcagcgtagcaactggcctctcactttcggcggagggaccaaggtggagatcaaacgaactgtggctgcaccatctgtctt

SEQ ID NO: 788720 - DNA, 452 bp, Homo sapiens
  misc_feature: NA.49.28.C06.1.454.light.4.multim50
agagctctggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgttttggccaggggaccaagctggagatcaagcgaactgtggctgcaccatctgttsattccc

SEQ ID NO: 788721 - DNA, 435 bp, Homo sapiens
  misc_feature: NA.49.28.C06.3.454.light.4.multim50
agctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacgtaacg

SEQ ID NO: 788722 - DNA, 444 bp, Homo sapiens
  misc_feature: NA.48.67.G01.3.454.light.4.multim50
ttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagaccccggtccg

SEQ ID NO: 788723 - DNA, 427 bp, Homo sapiens
  misc_feature: NA.49.28.C06.6.454.light.4.multim50
agtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatcccgtacacttttaggccaggggaccaggctggatatcagacgaacgtgtggctcg

SEQ ID NO: 788724 - DNA, 466 bp, Homo sapiens
  misc_feature: NA.48.67.G01.4.454.light.4.multim50
ttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaaggctgaccgtcctaaagtcagcccaaggctgccccctcggtcctacc

SEQ ID NO: 788725 - DNA, 463 bp, Homo sapiens
  misc_feature: NA.48.57.F02.2.454.light.4.multim50
ttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctcgtccccccg

SEQ ID NO: 788726 - DNA, 469 bp, Homo sapiens
  misc_feature: NA.48.67.G01.5.454.light.4.multim50
ttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagtattttacattttattactgtcagcagtatcgtaagtggactccgacgtttggaccaagggaccaaggtggaagtcaaacgaactgtggctgcaccatctgtcttcatccttcccgccta

SEQ ID NO: 788727 - DNA, 466 bp, Homo sapiens
  misc_feature: NA.48.57.F02.4.454.light.4.multim50
ttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtcactttcggccctgggaccaaaataaatagtcaatcgaactgtggctgcaccatctgtcttcattccc

SEQ ID NO: 788728 - DNA, 475 bp, Homo sapiens
  misc_feature: NA.48.57.F02.6.454.light.4.multim50
ttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctcgttcccgccctcct

SEQ ID NO: 788729 - DNA, 463 bp, Homo sapiens
  misc_feature: NA.48.57.F02.7.454.light.4.multim50
ttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 788730 - DNA, 487 bp, Homo sapiens
  misc_feature: NA.48.57.F02.9.454.light.4.multim50
ttgggtttggggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatacaaacgaactgtggctgcacctatctgtcttcatcttcccgccatctgatatgtata

SEQ ID NO: 788731 - DNA, 443 bp, Homo sapiens
  misc_feature: NA.48.30.C08.2.454.light.4.multim50
aagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggagggaccaagctgactgtccgaggt

SEQ ID NO: 788732 - DNA, 470 bp, Homo sapiens
  misc_feature: NA.40.81.H04.2.454.light.4.multim50
ctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctcgccccctcggtcactctcgttcccccg

SEQ ID NO: 788733 - DNA, 480 bp, Homo sapiens
  misc_feature: NA.49.87.H10.1.454.light.4.multim50
ttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctgccccctcggtcactctgttcccgt

SEQ ID NO: 788734 - DNA, 462 bp, Homo sapiens
  misc_feature: NA.49.87.H10.2.454.light.4.multim50
ttgggtttgggttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 788735 - DNA, 469 bp, Homo sapiens
  misc_feature: NA.48.30.C08.3.454.light.4.multim50
aagggaaaggggggaggaactgctcagttaggacccagacggaaccatggaagccccagcgcagcttctcttcctcctgctactctggctcccagatgtcactggagaaaaaataatgacgcagtctccagcccccctgcctgtgtctccaggggaaagagccaccctctcctgcagggccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagattttgctattttattactgtcagcactataataactggccacgtggacgttcggccaagggaccaaggtggaaatcaaacygaactgtggctgcacya

SEQ ID NO: 788736 - DNA, 482 bp, Homo sapiens
  misc_feature: NA.48.30.C08.4.454.light.4.multim50
aagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctsgccccctcggtcactctcgttcccrccctt

SEQ ID NO: 788737 - DNA, 450 bp, Homo sapiens
  misc_feature: NA.49.87.H10.4.454.light.4.multim50
tttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccgagggtggagatcaaacgtaacg

SEQ ID NO: 788738 - DNA, 437 bp, Homo sapiens
  misc_feature: NA.49.87.H10.6.454.light.4.multim50
ttgggtttggggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgttcaacagagttacagtatcccgtacacttttggcctaggggaccaggctggatatcagacgaactgtgg

SEQ ID NO: 788739 - DNA, 460 bp, Homo sapiens
  misc_feature: NA.48.30.C08.5.454.light.4.multim50
aaagggaaagggragrgmwmkggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcaccat

SEQ ID NO: 788740 - DNA, 470 bp, Homo sapiens
  misc_feature: NA.43.59.F04.2.454.light.4.multim50
tagggattgggggctggggtctcaggaggcagcgctctcgggacgtctccaccatggcctgggctctgctattcctcaccctcctcactcaggrcacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagccccaagggcccaacccccactgt

SEQ ID NO: 788741 - DNA, 479 bp, Homo sapiens
  misc_feature: NA.43.59.F04.3.454.light.4.multim50
tagggattggggctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctcgccccctcggtcactctgttcccaccctccctca

SEQ ID NO: 788742 - DNA, 522 bp, Homo sapiens
  misc_feature: NA.43.59.F04.1.454.light.4.multim50
tagggattgggcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactctgttccccg

SEQ ID NO: 788743 - DNA, 467 bp, Homo sapiens
  misc_feature: NA.49.49.E05.1.454.light.4.multim50
aacacacaaaggggtctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcctgcactgggagcagctccaacatcggggcaggttatgatgtacactggtatcagcagcttcccggaacagcccccaaactcctcatctatgatgacattaagcggccctcgggggtccctgaccgattctctggctccaagtctggcaccgcagcctccctggccatcactgggctccaggctgaggatgaggctgattattactgccagacctatgacaccagcctgactgtcgtggtcttcggcggagggaccgaggtgaccgtccttgggtccagaccccg

SEQ ID NO: 788744 - DNA, 447 bp, Homo sapiens
  misc_feature: NA.49.49.E05.2.454.light.4.multim50
aacacacaaagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcagtggaagtggatctgggacacattttactttcaccatcagcggcctgcagcctgaagattttgcaacatattactgtcaacagtatgatagatctcccactcactttcggcggagggaccaaggtggagatcagacgaactgtggcgtgcaccta

SEQ ID NO: 788745 - DNA, 454 bp, Homo sapiens
  misc_feature: NA.49.49.E05.3.454.light.4.multim50
aacacacaaagggggagtcagtctcagtcaggacccagcatggacatgagggtccccgctcagctcctggggctcctgctactctggctccgaggtgccagatgtgacatccagatgacccagtctccatcttccctgtctgcatctctgggagacagagtcaccatcacttgccaggcgagtcagaccattggcaacttttttaaattggtatcaacacaaaccagggaaagcccctaaactcctgatctatgctgcatccactttgcaaagtgggtcccttcaaggttccgtggcggtggatctgggacagatttcgctctcaccatcagcagtctccagcctgaagattttgcracwtaytactgtcaacagtatgatwwctctsmcmctcactttcggcggagggaccgamggtggasatcaaacgaactgtggctgcaccatctgtctt

SEQ ID NO: 788746 - DNA, 463 bp, Homo sapiens
  misc_feature: NA.43.87.H10.2.454.light.4.multim50
tttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggcccaacccctac

SEQ ID NO: 788747 - DNA, 456 bp, Homo sapiens
  misc_feature: NA.43.87.H10.3.454.light.4.multim50
ttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtaggaaatcaaacgaactgtaggctgcaccatctgtcttcatt

SEQ ID NO: 788748 - DNA, 485 bp, Homo sapiens
  misc_feature: NA.48.24.C02.1.454.light.4.multim50
tagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccaccctcctcta

SEQ ID NO: 788749 - DNA, 461 bp, Homo sapiens
  misc_feature: NA.48.24.C02.2.454.light.4.multim50
tagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccgccta

SEQ ID NO: 788750 - DNA, 467 bp, Homo sapiens
  misc_feature: NA.48.24.C02.3.454.light.4.multim50
tagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccgaacgtaggaaatcaaacgaactagtggctgcaccatctgtt

SEQ ID NO: 788751 - DNA, 469 bp, Homo sapiens
  misc_feature: NA.48.24.C02.4.454.light.4.multim50
tagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggccgaacggaccgaacggtaggaaagtacgaaacgaacctacgtggtcgtgyaccta

SEQ ID NO: 788752 - DNA, 468 bp, Homo sapiens
  misc_feature: NA.48.24.C02.6.454.light.4.multim50
tagggaaaggggagagctgctcagttaggacccagagggaaccatggaaaccccagcgcagcttctcttcctcctgctactctggctcccagatrccsccggagaaattktgttgacgcagtctccagrcaccctgtctttgtctccaggggaaagagccaccytctcctgcaggkccagtcagwrtsttascarcractacttagcctggtaccakcagaaacctggccaggctcccaggctcctcatctacggtgcatccagcagggccaytggcatcccagacaggttcagtggcagtgggtctgggacaracttcactctcaccrtcagcagactggascctgaagwwtttgcagtstattactgtcagcagtatrstarctcacckawsacsttccggccaagggaccamgastggagwatyaamcgaactgkkgctgcaccatctgtcttcatccttccccg

SEQ ID NO: 788753 - DNA, 462 bp, Homo sapiens
  misc_feature: NA.49.73.G07.2.454.light.4.multim50
agggcacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcct

SEQ ID NO: 788754 - DNA, 502 bp, Homo sapiens
  misc_feature: NA.49.73.G07.3.454.light.4.multim50
agggcacgaccggtgctcgatttagctctacgctcargggcacgaccggtgctcgatttagatcgtctgygtaawggagwwwggrggaggaactgctcagttaggacccagagggaaccatggaagccccagctcagcttctcttcctcctgctwctctggctcccagatayyaccggagaaaktgtgttgwcrcagtctccwgccaccctgtctttgtctccaggggaaagagccaccctctcctgcagggccastcagagtgttarcayctacttagyctggtaccaacagarasctggccassctcccaggctcctcatctatgatacatccamcagggccmctggcatcccagccaggttcagtggcagtgggtctgggacagacttcactctcaccatcagcagccytagagcctgaagattttgcagtytattactgtcagcagcgtatmaccgggatcaccttcggccaagggacccgactggagattaagcgaa

SEQ ID NO: 788755 - DNA, 485 bp, Homo sapiens
  misc_feature: NA.49.33.C11.6.454.light.4.multim50
ttkgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctcgaccatctctggggctccaggctgaggacgaggctgattattactgcagctcatatacaaacataaacacttgggtgttcgggcggcggggaccaaactgaccgtcctacgtcagcccaaggctcgccccctcggtcactcctcktccc

SEQ ID NO: 788756 - DNA, 488 bp, Homo sapiens
  misc_feature: NA.49.33.C11.7.454.light.4.multim50
ttgggtttgggggctgtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatagttcggcggagggaccaagactgaccgtcctaggtcagcccaaggcctcgccccctcggtcactctcgttcccrccctcctct

SEQ ID NO: 788757 - DNA, 479 bp, Homo sapiens
  misc_feature: NA.49.33.C11.9.454.light.4.multim50
ttgggtttgggggagtcagtcccaaccaggacacagcatggacatgagggtccctgctcagctcctggggctcctgctgctctggctctcaggtgccagatgtgacatccagatgacccagtctccatcctccctktskgywtgskgtaggagacagagtcaccatcacttgccaggcgagtcaggacattcgcaactatttaaattggtatcagcagaaaccagggaaagcccctaaactcttgatctacgatgtctccaatttggaaacagggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcacctatctgtcttcatcttcccgccatctgatctctcgact

SEQ ID NO: 788758 - DNA, 450 bp, Homo sapiens
  misc_feature: NA.48.62.F07.3.454.light.4.multim50
aagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcaggggtccctgctcgcttctctggctccaagtctggcaacacggcctccctgaccatctctgggctccaggctgaagatgaggctgattatttctgctgctcatatgcagccaactattatgtcttcggaactgagaccaaggtcaccgtcctaggtcagtaccccg

SEQ ID NO: 788759 - DNA, 504 bp, Homo sapiens
  misc_feature: NA.48.13.B02.1.454.light.4.multim50
tccgcgggcacgaccggtgctcgatttagtctagcgrsttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcggagggaccaagctgaccgtcctaggtcagcccaaggctcgccccctcggt

SEQ ID NO: 788760 - DNA, 509 bp, Homo sapiens
  misc_feature: NA.48.13.B02.3.454.light.4.multim50
tccgcggggggggtgagggtttagaacctatgaacatccgcgggggggctcagaagcagagttctggggtgtctccaccatggcctggacccctctctggctcactctcctcactctttgcataggctctgtggtttcttctgagctgactcaggaccctgctgtgtctgtggccttgggacagacggtcaggatcacatgccaaggagacagcctcagaaagttttctggaaactggtatcagcagaagccaggacaggcccctgttcttctcatctatggtgaaaatcaccggcccccagggatcccagaccgattctctggctctacctcaggagacacagcttccctgaccatcgctggggctcaggctgaagatgaggctgcctattattgtaactcccgggacagtagaggcgactatttcctaatattcggcggagggaccaagttgaccgtcctaggtcagcccaaggctgccccctcggtcactctgttcccgccctcct

SEQ ID NO: 788761 - DNA, 435 bp, Homo sapiens
  misc_feature: NA.48.70.G04.5.454.light.4.multim50
aggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcaccat

SEQ ID NO: 788762 - DNA, 452 bp, Homo sapiens
  misc_feature: NA.51.85.H08.3.454.light.4.multim50
tcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgmgaggccctcagggatccctgagcgattctctggctccaggtcagggacaacggtcacattgrccatcagtggagtccaggcagaggacgaggctgactattattgtcaatcaacagacaccattggtacttatgtcttcggaactgcgaccaaggtcaccgtcctgggtcagcccaaggccaaccccactgtcactc

SEQ ID NO: 788763 - DNA, 448 bp, Homo sapiens
  misc_feature: NA.51.30.C08.6.454.light.4.multim50
aagggaaagggggcaggagtcagtcccaaccaggacacagcatggacatgagggtccctactcagctcctggggctcctgctgctctggctctcaggtgccagatgtgacatccagatgacccagtctccgtcctccctgtctgcgtctgtaggagacagagtcaccatcacttgccaggcgagtcaggacattagcaacaatttgatctggtatcagcagaaacctggcagagcccctagtctcatgatctatgatgcatctattttggaagacggggtcccatcccggttcagtgggagtggatctgggacaaatttttctttcaccatcaccaacctgcaacctgaggattttgcaacatatttctgtcaacaatatgataatgtccccaccgtcactttcggcggagggaccaaggtggacctcaaacgaactgtggctgcacc

SEQ ID NO: 788764 - DNA, 458 bp, Homo sapiens
  misc_feature: NA.48.61.F06.2.454.light.4.multim50
agagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttctatcttccccg

SEQ ID NO: 788765 - DNA, 446 bp, Homo sapiens
  misc_feature: NA.48.24.C02.5.454.light.4.multim50
tagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctcctgaccatctctgggctccaggctgaggatgaggctgattattactgctgctcatatgcaggcagctacactttggcgttcggvvgagrgaccaagctgactgtcctggtcagacccc

SEQ ID NO: 788766 - DNA, 447 bp, Homo sapiens
  misc_feature: NA.49.56.F01.1.454.light.4.multim50
aacacacaaaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagaatcaccatcacttgccgggcgagtcaggacattagcaactatttaaattggtatcagcagaaaccagggaaagcccctaamctcctgatctacgatgcatccaatttggaaacaggggtcccatcaaggttcagtggaagtggatctgggacatattttactttcaccatcagcagmctgcagcctgaagatattgcaacatattactgtcaacagtatgatratctcccactcactttcggcggagggaccgaaggtggagatcagacgaactgtggctgcaccat

SEQ ID NO: 788767 - DNA, 445 bp, Homo sapiens
  misc_feature: NA.49.56.F01.3.454.light.4.multim50
aacacacaaaggggcagtcccagtcaggacacagcatggacatgagggtccccgctcagctcctggggctcctgctgctctggctcccaggtgccagatgtgacatccagttgacccagtctccatccttcctgtctgcatctgtcggagacagagtcaccatcacttgccgggccagtcagggcgttagtagttatttagcctggtatcaacaaaaaccagggaaagcccctaacctcctgatatatgctgcaaccactttgcaaagtggggtcccatcaaggttcagcggcagtggatctgggacagagttcactctcactatcagcagcctgcagcctgaagattttgcaacttattattgccatcaagttgatgcttacccgctcactttcggcggagggaccaaggtggagatcagacgaactgtggctgcacatctgtt

SEQ ID NO: 788768 - DNA, 516 bp, Homo sapiens
  misc_feature: NA.49.73.G07.1.454.light.4.multim50
agggcacgaccggtgctcgatttagctctacgctcagggcacgaccggtgctcgatttagacgcgatacgaagggttagagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccaaggtggagatcaaacgaactagtggctgcaccta

SEQ ID NO: 788769 - DNA, 501 bp, Homo sapiens
  misc_feature: NA.51.59.F04.1.454.light.4.multim50
tagggattgggcacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcacttccg

SEQ ID NO: 788770 - DNA, 465 bp, Homo sapiens
  misc_feature: NA.49.73.G07.4.454.light.4.multim50
agggcacgaccggtgctcgatttagyagaygtaswktcgcggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatcgtgggacgttattttacttycaccatcatcaacctgcacgcctagaggatattgacaacataattactgtacaacaatatgataatctaccactctactttcggcggagggaccgacggtaggagataacg

SEQ ID NO: 788771 - DNA, 467 bp, Homo sapiens
  misc_feature: NA.49.73.G07.5.454.light.4.multim50
agggcacgaccggtgctcgatttagtgctatagactawgggawwkggggagtcagtctcagtcaggacacagcatggacatgagggtccccgctcagctcctggggctcctgctactctggctccgaggtgccagatgtgacatccwgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatcccgtacacttttggccryaggggaccaggctggatatctagacgaa

SEQ ID NO: 788772 - DNA, 390 bp, Homo sapiens
  misc_feature: NA.49.73.G07.6.454.light.4.multim50
agggcacgaccggtgctcgatttagacgcgatcgaagggtttgggggtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaaggtggagatcaaacgaactgtggctgcaccatctgtcttcatcttcccgccatctgatctctcgact

SEQ ID NO: 788773 - DNA, 534 bp, Homo sapiens
  misc_feature: NA.49.73.G07.7.454.light.4.multim50
argggcacgaccggtgctcgatttagyagcackaywgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctgccccctcggtcactctgtccccaccctcctctctctcgact

SEQ ID NO: 788774 - DNA, 458 bp, Homo sapiens
  misc_feature: NA.49.33.C11.2.454.light.4.multim50
ttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgtctt

SEQ ID NO: 788775 - DNA, 467 bp, Homo sapiens
  misc_feature: NA.49.33.C11.3.454.light.4.multim50
ttgggtttggggctgggttgggtttgggggctgtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaaggctcccg

SEQ ID NO: 788776 - DNA, 469 bp, Homo sapiens
  misc_feature: NA.49.33.C11.4.454.light.4.multim50
ttgggtttkgggkywggagtsagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagawttttactttcaccatcagcaggctgcagcctgaagatattgcaacatattactgtcaacagtatgatagtctcccgctcactttcggcgggggaccgaaggtggagatcaagcgaactgtggctgcaccatctgtcttcatccttccgccat

SEQ ID NO: 788777 - DNA, 485 bp, Homo sapiens
  misc_feature: NA.49.33.C11.5.454.light.4.multim50
ttgggtttgggggctgtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgkttttcggtcggtagggaccaggctgaccgtcctgggtcagcccaaggctgccccctcggtctaccgtcccgggtcctaccgttccg

SEQ ID NO: 788778 - DNA, 431 bp, Homo sapiens
  misc_feature: NA.49.33.C11.8.454.light.4.multim50
ttgggtttgggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatcccgtacacttttggcctaggggaccaggctggataatcagacgaa

SEQ ID NO: 788779 - DNA, 451 bp, Homo sapiens
  misc_feature: NA.41.33.C11.1.454.light.4.multim50
ttgggtttgggggaggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggattatgcagtttactactgtctgcagtataaagactggcctagggtcactttcggccctgggaccaaagtggatttcaaacgaactgtggctgcaccattcg

SEQ ID NO: 788780 - DNA, 463 bp, Homo sapiens
  misc_feature: NA.48.37.D04.6.454.light.4.multim50
ttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgctagtttattattgtcagcagtataataattggcctccgggggtcactttcggccctgggaccaaaataaatgtcaatcgaactgtggctgcaccatctgtcttcatt

SEQ ID NO: 788781 - DNA, 443 bp, Homo sapiens
  misc_feature: NA.41.33.C11.5.454.light.4.multim50
ttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcaccta

SEQ ID NO: 788782 - DNA, 434 bp, Homo sapiens
  misc_feature: NA.51.37.D04.1.454.light.4.multim50
ttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccgaaggtggagatcaagcgaactgtgg

SEQ ID NO: 788783 - DNA, 467 bp, Homo sapiens
  misc_feature: NA.48.62.F07.2.454.light.4.multim50
aagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccgaacgtaggaaatcaaacgaactgtggctgcaccatctgttt

SEQ ID NO: 788784 - DNA, 496 bp, Homo sapiens
  misc_feature: NA.43.33.C11.1.454.light.4.multim50
ttgggtttgggywygaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccatctgtctt

SEQ ID NO: 788785 - DNA, 480 bp, Homo sapiens
  misc_feature: NA.48.62.F07.5.454.light.4.multim50
aagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccaccctt

SEQ ID NO: 788786 - DNA, 472 bp, Homo sapiens
  misc_feature: NA.48.62.F07.6.454.light.4.multim50
aagggaaagggggaagagctgctcagttaggacccagagggaaccatggaaaccccagcgcagcttctcttcctcctgctactctggctcccagatrscmccggagaaatygtgttgacgcagtctccagrcaccctgtctktgtctccaggggaaagagccaccytctcctgcaggkccagtcagagtsttascarcrrctacttagcctggtaccakcagaaacckggccaggctcccaggctcctcatctayggtgcatccagcagggccactggcatcccagacaggttcagtkgcagtgggtctgggacagacttcactctcaccrtcagcagactggascctgaagtattttgcartktattactgtcagcagtatggtasctcacccagrtmcactytyggccargggacacragctggagatyaamcgaactgtggctgcaccatctgtcttcactcttccccg

SEQ ID NO: 788787 - DNA, 467 bp, Homo sapiens
  misc_feature: NA.51.86.H09.2.454.light.4.multim50
ttgggtttggggagtctcagtcaggaywsrgywtgggrcwttcsmkggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagtattttgcaacttactactgtcaacagagttacagtacccctcagctcactttcggcggagggaccgaaggtggagatcaaacgaactgtggctgcaccatctgtcttcatcttcccgccat

SEQ ID NO: 788788 - DNA, 496 bp, Homo sapiens
  misc_feature: NA.43.53.E09.2.454.light.4.multim50
ttgggtttgggcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccatctgtctt

SEQ ID NO: 788789 - DNA, 493 bp, Homo sapiens
  misc_feature: NA.47.83.H06.1.454.light.4.multim50
tcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttgggtgttcggcggagggaccaagctgaccgttcgtaggtcagcccaaggctcgccccctcc

SEQ ID NO: 788790 - DNA, 441 bp, Homo sapiens
  misc_feature: NA.49.61.F06.2.454.light.4.multim50
aggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtcttca

SEQ ID NO: 788791 - DNA, 450 bp, Homo sapiens
  misc_feature: NA.49.30.C08.7.454.light.4.multim50
aagggaaagggggagaagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagccygaagattttgcagtatattactgtcagcatgggagcattcgtgcgctcaccttcggcggagggaccaaggtggagatmmaacgaactgtggctgcaccta

SEQ ID NO: 788792 - DNA, 439 bp, Homo sapiens
  misc_feature: NA.49.61.F06.4.454.light.4.multim50
cacgaccggtgctcgatttagatcgtagcagaacacacaaagggggagagctgctcagttaggacccagagggaaccatggaaaccccagcgcagcttctcttcctcctgctactctggctcccagatgtcaccggagaaattgtgttgacgcagtctccaggcaccgtgtctttgtctccgggggaaagagtctccctctcctgcagggccagtcagagtcttggcagcagcaagttagcctggtatcagcagaaacctggccagccctccccggctcctcatctctgatgcaaccagcagggcctctggcatcccagacaggttcagtggcagtgagtctggcgcagacttcactctcaccatcagcagactggagcctgarkattttgcagtgtattactgtcagcagtatggttacttcatttcgtgtacttttc

SEQ ID NO: 788793 - DNA, 472 bp, Homo sapiens
  misc_feature: NA.52.53.E09.2.454.light.4.multim50
ttgggtttgggggggggagcytrgstttgggtgtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagcccggccaggcccctgtcttgcttatttataaagactttgagaggccctcagggacccctgagcgattctctggctccagctcagcgacaacagtcacgttgaccatcagtggagtccaggcagaggacgaggctgactattactgtcagtcatcagacagcagtggcacttatgtcgtattcggcggagggaccaaactgaccgtcctaggtcagcccaaggctgccccctcg

SEQ ID NO: 788794 - DNA, 469 bp, Homo sapiens
  misc_feature: NA.48.53.E09.2.454.light.4.multim50
ttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcrgcctgcaggctgargatgtggcagtttattactgtcagcamtrttwtrctactccgtggactttcggcsragggaccgaaggtggarrtcaracgaacttgtggctgcaccatctgtctt

SEQ ID NO: 788795 - DNA, 481 bp, Homo sapiens
  misc_feature: NA.52.53.E09.4.454.light.4.multim50
ttgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcggggtggaggctgaggatgttggggtttattactgcatgcaaggtacacactggcctccgacgttcggccaagggaccaaggtrggaatacaaacgaactagtggctgcaccatctgtcttctatcttccccg

SEQ ID NO: 788796 - DNA, 479 bp, Homo sapiens
  misc_feature: NA.52.53.E09.5.454.light.4.multim50
ttgggtttggggsstggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcattttkkaggtcactaagcggccctcaggggtccctgatcgcttctctggctcgaagtctggcaacacggcctccctgaccgtctctgggctccaggctgaggatgaggctgattactactgcacctcatatgcaggcgacaacaattttgggggttttcggcggtagggaccrargtgaccgtcctacgtcagcccaaggctcgccccctccggtcactc

SEQ ID NO: 788797 - DNA, 477 bp, Homo sapiens
  misc_feature: NA.51.33.C11.1.454.light.4.multim50
ttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaagtacaaacgaaactgtggctgcaccatctgtcttctattcc

SEQ ID NO: 788798 - DNA, 438 bp, Homo sapiens
  misc_feature: NA.51.33.C11.7.454.light.4.multim50
ttgggtttgggggcagaagtcwswcycagtcaggacacagcatggacatgagggtcccygctcagctcctgggrctcctgctgctctggctcccagrtrccaratgtgacatccagatgacccagtctccwtccwccctgtctgcatctrtaggagacagagtcascatcacttgccgggcsastsagarkmktcagyawttrkttggcctggtatcagcagaraccagggaaagcycctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagtgccgttgcgctcactttcggcggggggaccgaacggtggagatcaagcgaa

SEQ ID NO: 788799 - DNA, 484 bp, Homo sapiens
  misc_feature: NA.49.80.H03.1.454.light.4.multim50
aagggaaaggggggraagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctgttcccgccctt

SEQ ID NO: 788800 - DNA, 447 bp, Homo sapiens
  misc_feature: NA.49.80.H03.3.454.light.4.multim50
aagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttgagatggtatcaacagaaaccagggaaagcccctaaactcctgatctatgctacattcgttttacaaagtggggtcccatcaaggttcagtggcagtggatctgggacagatttcactcttcaccatcagcagtctgcaacctgaagattttgcaacttactactgtcaacagagttacagtaccccaattcactttcggccctgggaccaaagtggatatcaaacgaactagtggctgcaccat

SEQ ID NO: 788801 - DNA, 449 bp, Homo sapiens
  misc_feature: NA.49.80.H03.4.454.light.4.multim50
aagggaaaggggacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggctttgatgtccactggtaccagcagcttccaggaacagcccccaaactcctcatctatggtaacaacaatcggccctcaggggtccctgaccgattctctgcctccaagtctgccacctcggcctccctggccatcactgggctccaggctgaagatgaggctgattattactgccagtcctatgacagcaccatgagtcgttccgtggtcttcggcggagggacccagctgaccgtcctaggtcagcccaagg

SEQ ID NO: 788802 - DNA, 462 bp, Homo sapiens
  misc_feature: NA.48.28.C06.6.454.light.4.multim50
agaggccctggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 788803 - DNA, 459 bp, Homo sapiens
  misc_feature: NA.40.34.D01.2.454.light.4.multim50
ttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttggctgctcttatgcaggcagtttcgctctcgaagtgttcggcggagggaccgagctgaccgtcctacgtcagcccaaggctccgg

SEQ ID NO: 788804 - DNA, 430 bp, Homo sapiens
  misc_feature: NA.48.70.G04.1.454.light.4.multim50
ctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggagggaccaagctgactgtcctaggt

SEQ ID NO: 788805 - DNA, 473 bp, Homo sapiens
  misc_feature: NA.48.70.G04.2.454.light.4.multim50
aggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcactcttcccgccta

SEQ ID NO: 788806 - DNA, 455 bp, Homo sapiens
  misc_feature: NA.48.70.G04.3.454.light.4.multim50
agctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccgaacgtggaaatcaaacgaactagtggctgcaccatctgttt

SEQ ID NO: 788807 - DNA, 455 bp, Homo sapiens; identical to SEQ ID NO: 788806
  misc_feature: NA.48.68.G02.3.454.light.4.multim50

SEQ ID NO: 788808 - DNA, 482 bp, Homo sapiens
  misc_feature: NA.41.30.C08.1.454.light.4.multim50
aaagggaaaggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaaccccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggcccaaccccactgtcactctcgttcccccg

SEQ ID NO: 788809 - DNA, 478 bp, Homo sapiens
  misc_feature: NA.40.67.G01.1.454.light.4.multim50
ttgggtttgggttgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggccccctcacgttcggcggagggaccaaggtggacatcaaacgaactgtggctgcaccatctgtcttcatcttcccgccat

SEQ ID NO: 788810 - DNA, 502 bp, Homo sapiens
  misc_feature: NA.51.85.H08.1.454.light.4.multim50
tcgcggggagcttcagctgtgggtcgcgggagacaggactcaggacaatctccagcatggccagcttccctctcctcctcaccctcctcactcactgtgcagggtcctgggcccagtctgtcctgactcagccaccctcagcgtctgggacccccgggcggagggtcgccatctcttgttctggaagcagctccaacatcggaagtaatgctgtcaactggtatcaacaactcccaggatcggcccccagactcctcatttttaataatgatcagcgggcctcaggggtccctgaccgattctctgcctccaagtcaggcacctcagcctccctggccatcagtgggctccagtctgaggatgaggctgattattattgtgcagcgtgggatgacagcctgtatatgtctctcttcggaggaggcacccagctgaccgtcctcggtcagcccaaggctcgccccctcggtcactctcgttcccaccctcctctcgtagcact

SEQ ID NO: 788811 - DNA, 468 bp, Homo sapiens
  misc_feature: NA.51.85.H08.2.454.light.4.multim50
tctcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgctagtttattattgtcagcagcgaaacaactggcctccttggacgttcggccaagggaccaaggtggaaatacaaacgaactgtggctgcaccatctgtcttcattcccgccccg

SEQ ID NO: 788812 - DNA, 449 bp, Homo sapiens
  misc_feature: NA.41.35.D02.4.454.light.4.multim50
ttgggtttggggttccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcagtgggacagcagcctcaatgtttgggtgttcggcggagggacctaagctgaccgtcctaggtcacc

SEQ ID NO: 788813 - DNA, 452 bp, Homo sapiens
  misc_feature: NA.40.85.H08.1.454.light.4.multim50
tcgcggggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttgggctggtatcagcagaaaccagggagagcccctaagctcctcatctatgctgcatccactttacaaagtggagtcccatcaaggttcagcggcagtggatctggcacagatttcactctcaccatcagcagcctgcagcctgaagattttgctaacttattattgtctacacgactacagttaccctcggacgttcggtccgaagggaccgaacggtaggaaagtacaaacgaactagtggcgtgcacctamg

SEQ ID NO: 788814 - DNA, 462 bp, Homo sapiens
  misc_feature: NA.4.39.D06.1.454.light.4.multim50
cagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctcc

SEQ ID NO: 788815 - DNA, 436 bp, Homo sapiens
  misc_feature: NA.51.53.E09.2.454.light.4.multim50
ttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccgaaggtggagatcaagcgaactgtggct

SEQ ID NO: 788816 - DNA, 455 bp, Homo sapiens
  misc_feature: NA.51.53.E09.4.454.light.4.multim50
ttgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccgaagctgaccgtcctcggtcagcccaaggctcgccccctcggtccgt

SEQ ID NO: 788817 - DNA, 480 bp, Homo sapiens
  misc_feature: NA.51.53.E09.5.454.light.4.multim50
ttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgwagttttcggcggagggaccagtctgaccgtcctaggtcagcccaaggctcgccccctcggtcactctcgttcccgccctcctctaccg

SEQ ID NO: 788818 - DNA, 476 bp, Homo sapiens
  misc_feature: NA.49.62.F07.1.454.light.4.multim50
aagggaaaggggggraagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactcttccg

SEQ ID NO: 788819 - DNA, 429 bp, Homo sapiens
  misc_feature: NA.49.6.A06.2.454.light.4.multim50
agggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattaactgtcaacagtatgatagtctcccgctcactttcggtcggagggaccaaggtggagatcaaacgaactgtgg

SEQ ID NO: 788820 - DNA, 514 bp, Homo sapiens
  misc_feature: NA.49.6.A06.1.454.light.4.multim50
agggcacgaccggtgctcgatttagatctactgacaggaggggggggtctcaggaggcagcgctctcaggacgtcaccaccatggcctgggctctgctcctcctcaccctcctcactcagggcacagggtcctgggcccagtctgccctgactcagccgccctccgcgtccgggtctcctggacagtctgtcaccatctcctgcactggaaccagcagtgacgttggtgattataactatgtctcctggtaccaacagtacccaggcaaagcccccagactcatgatttatgcggtcagtaagcggccctcaggggtccctgatcgcttctctggctccaagtctggcaacacggcctccctgaccgtctctgggctccgggctgaagatgaggctgattatttctgcagctcatatgcaggcagcaacaattttgtgatattcggcggagggaccaagctgaccgtcctaggtcagcccaaggctgccccctccstcactctgttcccgccct

SEQ ID NO: 788821 - DNA, 438 bp, Homo sapiens
  misc_feature: NA.49.83.H06.1.454.light.4.multim50
tcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgtcctrrgtcacgcccaasgctcc

SEQ ID NO: 788822 - DNA, 477 bp, Homo sapiens
  misc_feature: NA.49.83.H06.3.454.light.4.multim50
tcgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaactcctgatctatgaggcgtctagtttagaaagtggggtcccttcaaggttcagcggcagtggatctgggacagaattcactctcaccatcaacagcctgcagcctgatgattttgcaacttattactgccaacactataatcattattctccggccactttcggccctgggaccaggctagatatcggacgaactgtggctgcaccatctgtcttcatcttcccgccatctgatctctcgact

SEQ ID NO: 788823 - DNA, 446 bp, Homo sapiens
  misc_feature: NA.49.83.H06.4.454.light.4.multim50
tcgcgggggatcaggacttctcagttcatcttctcaccatgaggctccctgctcagctcctggggctgccaatgctctggaaacctgggtccagtgcggatattgtgatgacccagactccactctttctgtccgtcacccctggacagccggcctccatctcctgcaagtctagtcagaccctccagcatagtcttggcaagacctatttccatagtcacctgcacaagccaggccagcctccacaggtcctgatctatgatgtttccagccggttctctggagtggcggatgggttcagtggcagcgagtcagggccaggcttcacactgaaaatcagccgggtggaggctgaggatgttggggtttattattgcatgcagaggatagagactccctccgagtacttttggccgaggggaccgagctggagatacaaacgaact

SEQ ID NO: 788824 - DNA, 455 bp, Homo sapiens
  misc_feature: NA.51.30.C08.1.454.light.4.multim50
aagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccaaggtggaaatgaaaggaactgtggctgcaccatctgtctt

SEQ ID NO: 788825 - DNA, 449 bp, Homo sapiens
  misc_feature: NA.51.30.C08.2.454.light.4.multim50
aagggaaagggcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacacctacttgacttggtttcagcagaggcctggccaatctccaaggcgccttatttataaggtttctaatcgggactttggggtcccagacagattcagcggcagtgggtcacgcactcacttcacactgaaaatcagcagggtggaggctgaggatttaggggtttattactgcatgcaaggtacacactggcctccgtacacttttggccaggggaccaagctcgagatcaaacgaactgtggctgcaccatctgtcttcatcttcccgccatctgatcgtagcact

SEQ ID NO: 788826 - DNA, 463 bp, Homo sapiens
  misc_feature: NA.51.30.C08.5.454.light.4.multim50
aagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagcccaaggcctccgcctcccgaacggacgtcccg

SEQ ID NO: 788827 - DNA, 485 bp, Homo sapiens
  misc_feature: NA.51.30.C08.4.454.light.4.multim50
aaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacaatcagtggggcccaggtgggggatgagggtgattactactgttactcaacagacattactactactcatagggtgttcggcggagggaccaagctgaccgtcctaggtcagcccaaggctcgccccctcggtcactctcgttcccaccctcctctcgtacg

SEQ ID NO: 788828 - DNA, 452 bp, Homo sapiens
  misc_feature: NA.51.30.C08.7.454.light.4.multim50
aagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagtattttgctaacttactactgtacaacagagttacggtaccctgctcacgtttcggcggagggaccaaggtggagatacaaacgaactgtggctgcaccta

SEQ ID NO: 788829 - DNA, 415 bp, Homo sapiens
  misc_feature: NA.48.32.C10.1.454.light.4.multim50
agtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcgtacgttcggccaagggaccaaggtggaaatcaaacgaa

SEQ ID NO: 788830 - DNA, 458 bp, Homo sapiens
  misc_feature: NA.48.32.C10.3.454.light.4.multim50
tggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctggggtccctcctcgattctctggctccatcgacaggtcctccaactccgcctccctcttcatctctgaactgaagactgaggacgaggctgcttattactgtcagtcctctgatggcagcgcagttgtcttcggcggagggaccacactgaccgttatcggtcagcccaaggctcgccccctcggtcactccg

SEQ ID NO: 788831 - DNA, 437 bp, Homo sapiens
  misc_feature: NA.48.61.F06.3.454.light.4.multim50
ctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggagggaccaagctgactgtcctaggtcagcccc

SEQ ID NO: 788832 - DNA, 435 bp, Homo sapiens; identical to SEQ ID NO: 788761
  misc_feature: NA.48.61.F06.5.454.light.4.multim50

SEQ ID NO: 788833 - DNA, 455 bp, Homo sapiens
  misc_feature: NA.48.61.F06.6.454.light.4.multim50
agctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccgaacgtggaawwcaaacgaactagtggctgcaccatctgtt

SEQ ID NO: 788834 - DNA, 493 bp, Homo sapiens
  misc_feature: NA.52.29.C07.2.454.light.4.multim50
agggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagaaatgacattggtacttataattctgtctcctggtaccaacaatacccmggcaaagyccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaarctgaccgtcctacgtcagcccaaggctgccccctcggtcactctgttccccgccctcctctatacg

SEQ ID NO: 788835 - DNA, 449 bp, Homo sapiens
  misc_feature: NA.52.29.C07.3.454.light.4.multim50
agggaaagggggaagagctgctcagttaggacccagagggaaccatggaaaccccagcgcagcttctcttcctcctgctactctggctcccagatatcaccggggaaattgtgttgacgcagtctccaggcaccctgtctttgtctccaggggaaagagtcaccctctcctgcagggccagtcagagtgttctcgccagctacttagcctggtaccagcagaaacctggccaggctcccaggctcctcatctatgcttcatccagcagggccgctggcatcccagacaggttcagtggcagtgggtctgggacagacttcactctgaccatccgcagactggagcctgaagattttgcggtgtattattgtcagcactatgatacctcactcatgtacacttttggccaggggaccaargctggagatcaaacgaactgtggctgcacc

SEQ ID NO: 788836 - DNA, 449 bp, Homo sapiens
  misc_feature: NA.48.78.H01.1.454.light.4.multim50
aggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 788837 - DNA, 463 bp, Homo sapiens
  misc_feature: NA.49.34.D01.5.454.light.4.multim50
tttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctggggacagagttcactctcaccatcagcagcctgcagtctgaagattttgctagtttattactgtcagcagtataatgtccgggctccggacactttcggcggaggggaccgaaggtggagatacaaacgaactagtggctgccaccatctsttcg

SEQ ID NO: 788838 - DNA, 454 bp, Homo sapiens
  misc_feature: NA.48.78.H01.3.454.light.4.multim50
ctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcgccccctcggt

SEQ ID NO: 788839 - DNA, 442 bp, Homo sapiens
  misc_feature: NA.48.78.H01.4.454.light.4.multim50
ctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctcgccccctc

SEQ ID NO: 788840 - DNA, 454 bp, Homo sapiens
  misc_feature: NA.48.78.H01.5.454.light.4.multim50
aggaactgctcagttaggacccagacggaaccatggaagccccagcgcagcttctcttcctcctgctactctggctcccagatdccactggagaaatagtgatgacgcagtctccagccaccctgtctgtgtctccaggggaaagagccaccctctcctgcagggccagtcagagtvttagcagcaacttagcctggtaccagcaaaaacctggccagvctcccaggctcctcatctatgvtgcatccaccagggccactggtatcccagccaggttcagtggcagtgggtctgggacagagttcactctcaccatcagcagcctgcagtctgaagattttgcadtttattactgtcagcagtataataabtggmctccggacgttcggccaagggaccaaggtaagaagtcaaacgaactgtggctgcaccatctgtcttcatcytycccgcc

SEQ ID NO: 788841 - DNA, 464 bp, Homo sapiens
  misc_feature: NA.48.78.H01.9.454.light.4.multim50
ctgtgggctcaggaggcagagctctgggaatctcaccatggcctggacccctctcctgctccccctcctcactttctgcacagtctctgaggcctcctmtgagctgacacagccaccctcggtgtcagtgtccccaggacaaacggccaggatcacctgctctggagatgcattgccaaraaaatwtksttattggtaccarcwgaagtcaggccaggcccctgtsctggtcatytwtgaggacracmarcgaccctccrggatccctgmgagrttctctggmtcsarctcagggacawtggccaccttgactatcamtggggcccaggtggasgatgargstgactactwctgttyctcaacagacasyagtgryratcrwgsgmtkttcggcggagggaccaaggctgaccgtcctrrgtcagcccaaggctgccccctcggtcactctgttcccgcctcct

SEQ ID NO: 788842 - DNA, 466 bp, Homo sapiens
  misc_feature: NA.52.28.C06.1.454.light.4.multim50
taagaaatacctgcaactgtcagcctcagcagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcaggacgtgggacactggcagtttgggtgttcgggcggagggaccaagttgaccgtcctaggtcagcccaaggctccg

SEQ ID NO: 788843 - DNA, 422 bp, Homo sapiens
  misc_feature: NA.49.78.H01.5.454.light.4.multim50
aggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgctaacttattattgtcaacagagttacagtatcccgtacacttttggcctaggggaccaaggctggatatcagacgaaa

SEQ ID NO: 788844 - DNA, 450 bp, Homo sapiens
  misc_feature: NA.52.28.C06.4.454.light.4.multim50
aggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcattcccg

SEQ ID NO: 788845 - DNA, 448 bp, Homo sapiens
  misc_feature: NA.52.28.C06.5.454.light.4.multim50
ctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcacttcc

SEQ ID NO: 788846 - DNA, 436 bp, Homo sapiens
  misc_feature: NA.52.28.C06.7.454.light.4.multim50
agtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaacaccttaatagttactccttcactttcggccctgggaccaaagtggacatcaacgaactgtggctgcaccatctgtctt

SEQ ID NO: 788847 - DNA, 456 bp, Homo sapiens
  misc_feature: NA.52.28.C06.8.454.light.4.multim50
tgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcctgcatagtaatggaaacaactatttgaattggttcctgcagaagccagggcagtctccacaactcctaatctattggggttctattcgggcctccggggtccctgacaggttcagtggcagtgggtcaggcacagattttacactgagaatcaccagagtggaggctgaagattttggggtttatttctgcatgcaaagtctacacacaccctggacgttcggccaagggaccaacggtaggaaatacaaacgaactagtggctgcaccactctgtt

SEQ ID NO: 788848 - DNA, 452 bp, Homo sapiens
  misc_feature: NA.52.28.C06.9.454.light.4.multim50
aggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagtattttgctagtttattactgtcagcagcgtagccactggctctctttcgggcggagggaccaaggttgagatcaaacgaactgtggctagcaccatctgtcttcatccttccccg

SEQ ID NO: 788849 - DNA, 428 bp, Homo sapiens
  misc_feature: NA.52.28.C06.10.454.light.4.multim50
ctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtcccctgtcctggtcatctatcaagatgtcaagcggccctcagggatccctgagcgattctctggctccaactctgggaacacagccactctagaccatcacgcgggacccaggctatggatgaggctgactattactgtcaggcgtgggacagcaacactgtggtattcggcggagggaccaagctagaccgtacctaaggtcagcccaa

SEQ ID NO: 788850 - DNA, 444 bp, Homo sapiens
  misc_feature: NA.40.23.C01.2.454.light.4.multim50
tagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagaccccggtccg

SEQ ID NO: 788851 - DNA, 450 bp, Homo sapiens
  misc_feature: NA.48.60.F05.1.454.light.4.multim50
ggggggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccggggaccaaggtggatctcaaaagaactgtggctgcacc

SEQ ID NO: 788852 - DNA, 466 bp, Homo sapiens
  misc_feature: NA.48.60.F05.2.454.light.4.multim50
gggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgtcggtccgaagggaccgaacggtaggwaagtackaaacgaactagtggcgtgcgacctaa

SEQ ID NO: 788853 - DNA, 469 bp, Homo sapiens
  misc_feature: NA.48.34.D01.10.454.light.4.multim50
ttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtacttacgttgggttktcggtcagrrggaccaagctgaccgtcctaggtcacggcccaaggctcctgtccccccg

SEQ ID NO: 788854 - DNA, 486 bp, Homo sapiens
  misc_feature: NA.48.60.F05.4.454.light.4.multim50
gggaaagggggaggttctttctctgggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtacttttagtttacgtcggaccttcggccaagggacacgactggagattaaacgaactgtggctgcaccatctgtcttcatcttcccgccta

SEQ ID NO: 788855 - DNA, 477 bp, Homo sapiens
  misc_feature: NA.48.60.F05.7.454.light.4.multim50
gggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccaccct

SEQ ID NO: 788856 - DNA, 449 bp, Homo sapiens
  misc_feature: NA.48.60.F05.8.454.light.4.multim50
gggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcaggggtccctgctcgcttctctggctccaagtctggcaacacggcctccctgacccatctctgggctccaggctgaagatgaggctgattatttctgctgctcatatgcagccaaactattatgtcttcggaactgacgaccaagkycaccgtcctagtcacgacccg

SEQ ID NO: 788857 - DNA, 498 bp, Homo sapiens
  misc_feature: NA.41.87.H10.1.454.light.4.multim50
tttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaatttcagggtatttggcggagggaccaagctgaccgtcctgggtcagcccaaggctgccccctcggtcactctgttcccgacctcctcatagtataga

SEQ ID NO: 788858 - DNA, 467 bp, Homo sapiens
  misc_feature: NA.48.60.F05.10.454.light.4.multim50
gggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagtattttactctcaccatcagtagcctgcaggctgaagatgtggcagtttattactgtcaacaatattattatacctccgccgacgttcggccgggggaccaacgtggaaatcaaacgaactgtggctgcaccatctgtctt

SEQ ID NO: 788859 - DNA, 486 bp, Homo sapiens
  misc_feature: NA.41.87.H10.2.454.light.4.multim50
ttgggtttggggkgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctcgttccccaccctccctctaac

SEQ ID NO: 788860 - DNA, 473 bp, Homo sapiens
  misc_feature: NA.51.35.D02.3.454.light.4.multim50
ttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggraccagcrgtgacrttggtggttwataaytatgtctcctggtaccarcaccacccaggcaaagcccccaaactcatgatttatgatgtcagtgatcggccctcaggggtttcgaatcgcttctctggctccaagtccggcaacacggcctccctgaccatctctggsctccaggccgaggacgaggctgattattactgcasctcatatacaakcaryaacaattgggtgttcggcggagggaccaagrctgaccgtcctaggtcacgcccaaggctgccccctcggtccta

SEQ ID NO: 788861 - DNA, 451 bp, Homo sapiens
  misc_feature: NA.13.10.A10.2.454.light.4.multim50
aggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggatatttgttgagggatagatatgcttgttggtatcaacagaaggccggccagtcacctacattggttatctatgaagacacgaagcggccctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtcctaggtcagcccaaggctgccccctcggtctacc

SEQ ID NO: 788862 - DNA, 492 bp, Homo sapiens
  misc_feature: NA.13.10.A10.3.454.light.4.multim50
aggggaggagagacccctcccctgggatcctgcagctctagtctcccgaggggctgggcctcaggaagcagcatcggaggtgcctcagccatggcatggatccctctcttcctcggcgtccttgcttactgcacaggatcsgtggcctcswatgrsctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccaacgccaacccc

SEQ ID NO: 788863 - DNA, 467 bp, Homo sapiens
  misc_feature: NA.40.35.D02.5.454.light.4.multim50
ttgggtttggggggggtctcaggaggcagcactctcgggacgtctccaccatggcctgggctctgctcctcctcagcctcctcactcagggcacaggatcctggrctcastctrccctgactcagcctcgctcagtgtccgggtctcctggacagtcagtcaccmtctcctgcactggaaccagcagtratrttggtgsttataactwtgtctcctggtaccaacwmcacccaggcaaagcccccaaaytcwtgatttmtgaygtcartaagcggccctcaggggtccctgatcgcttctctggctccaagtctggcaacacggcctccctgacccrtctctgggctccaggctgargatgaggctgattattactgctrctcrtwtgcaggcggywaswwttgggtsttcggcggagggaccaaggctgaccgtcctaggtcagcccaaggctgccccctsgcact

SEQ ID NO: 788864 - DNA, 464 bp, Homo sapiens
  misc_feature: NA.48.33.C11.4.454.light.4.multim50
ttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcgccccctc

SEQ ID NO: 788865 - DNA, 469 bp, Homo sapiens
  misc_feature: NA.48.33.C11.2.454.light.4.multim50
ttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctcgttccccg

SEQ ID NO: 788866 - DNA, 470 bp, Homo sapiens
  misc_feature: NA.48.33.C11.3.454.light.4.multim50
ttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttatcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcagcctgcaggctgaggatgtggcagtttattactgtcagcaatattatactactccgtggactttcggccaagggaccgaaggtggaaagtcagacgaactgtggctgcaccatctgtctt

SEQ ID NO: 788867 - DNA, 464 bp, Homo sapiens
  misc_feature: NA.48.33.C11.5.454.light.4.multim50
ttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggttttattactgtcagcagcgtgccaactggcctctcacgttcggcggagggaccaaggtggacatcaaacgaactgtggctgcaccatctgtcttcatcttccccg

SEQ ID NO: 788868 - DNA, 471 bp, Homo sapiens
  misc_feature: NA.48.9.A09.3.454.light.4.multim50
agggcacgaccggtgctcgatttagacgmgagtgygwwgggkttkggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcacg

SEQ ID NO: 788869 - DNA, 463 bp, Homo sapiens
  misc_feature: NA.48.33.C11.7.454.light.4.multim50
ttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggcyccaagtctggcaacacggcctccctgacaatctctgggctccaggctgaggacgaggctgattattattgctgctcatatgcaggtggtactacttkgggtgttcggcaggagggaccaagctgaccgtcctaggtcagcccaaggctgccccctc

SEQ ID NO: 788870 - DNA, 457 bp, Homo sapiens
  misc_feature: NA.4.27.C05.1.454.light.4.multim50
aagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtcactccg

SEQ ID NO: 788871 - DNA, 445 bp, Homo sapiens
  misc_feature: NA.49.27.C05.4.454.light.4.multim50
agggtttgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagacgtgaagatgtggcagtgtattactgtcagcaatatcacactgctccgctcactttcggcggagggaccacgggtggagatacaaacgaa

SEQ ID NO: 788872 - DNA, 460 bp, Homo sapiens
  misc_feature: NA.13.11.A11.1.454.light.4.multim50
aggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggtaccaacagaaaccaggacagcctccgaagttactcttttactgggcgtctacccgggaatccggggtccctgaccgattcagtggcagcgggtctgggacagatttcactctcaccatcagcagccttcaggctgaagatgtggcagtttattactgtcagcaatattatatctctcctcctcggacgttcggccragggaccagggtggaaatcaaacgaactgtggctgcaccatctgtcttcatccttcccgcctat

SEQ ID NO: 788873 - DNA, 467 bp, Homo sapiens
  misc_feature: NA.13.11.A11.3.454.light.4.multim50
ggggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctgttcccccg

SEQ ID NO: 788874 - DNA, 437 bp, Homo sapiens
  misc_feature: NA.13.11.A11.4.454.light.4.multim50
agggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagaccccg

SEQ ID NO: 788875 - DNA, 462 bp, Homo sapiens
  misc_feature: NA.13.11.A11.5.454.light.4.multim50
aggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaaataccaggcggccctctggggtccctgagcgattctccggctccgcctcgtgggaacacagtcactctgaccatcagcgggacccagcctattgatgaggctgtctacttctgtcaggcgtgggacaacagcgtgctgttcggcggagggaccagtctgaccgtcttaggtcacgcccaaggctcgccccctcggtcactctcgttccscacccc

SEQ ID NO: 788876 - DNA, 495 bp, Homo sapiens
  misc_feature: NA.48.37.D04.1.454.light.4.multim50
ttgggtttggggagggatacgcgtgacagataagaagggcgtggttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtcacgg

SEQ ID NO: 788877 - DNA, 472 bp, Homo sapiens
  misc_feature: NA.48.37.D04.3.454.light.4.multim50
ttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccaccctt

SEQ ID NO: 788878 - DNA, 462 bp, Homo sapiens
  misc_feature: NA.48.55.E11.6.454.light.4.multim50
ttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcaggagggaccaagctgaccgtcctaggtcagcccaaggctcgccccccg

SEQ ID NO: 788879 - DNA, 459 bp, Homo sapiens
  misc_feature: NA.48.37.D04.7.454.light.4.multim50
gttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctccg

SEQ ID NO: 788880 - DNA, 469 bp, Homo sapiens
  misc_feature: NA.48.37.D04.8.454.light.4.multim50
ttgggtttggggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagccctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagccctagasscccgaagtattttgcggttttattactgtcagcagcgtgccaactggcctctcacgttcgggcggagggaccaaggtggacatcaaacgaactgtggctgcaccatctgtcttcatctccccg

SEQ ID NO: 788881 - DNA, 468 bp, Homo sapiens
  misc_feature: NA.13.37.D04.1.454.light.4.multim50
ttgggtttggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggttcttctgtggtcttcggcggagggtccaaagtgaaccgtcctaggtcagcccaaggctgccccctcggtctacg

SEQ ID NO: 788882 - DNA, 422 bp, Homo sapiens
  misc_feature: NA.41.14.B03.2.454.light.4.multim50
tccgcggtcacgaccggtgctcgattttccgcgggtagttccgcgggcacgaccggtgctcgatttagtgtgagctgastttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 788883 - DNA, 474 bp, Homo sapiens
  misc_feature: NA.41.14.B03.3.454.light.4.multim50
tccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcgaggggtttctgatcgcttctctggctccaagtctggcaatacggcctccctgacagtctctcggctccaggcggaggacgaggctgattactactgtcttctcatatgcagatactaagtcctgggtgttcggcggagggaccaagctgaccgtcctaggtcagcccaaggctcgccccctcggtcactcttccg

SEQ ID NO: 788884 - DNA, 424 bp, Homo sapiens
  misc_feature: NA.26.78.H01.2.454.light.4.multim50
cagagccctggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgctactttattactgtcagcagcgtagcaactggcctctcactttcggcggagggaccagggtggagatcagacgaactgtggctgcaccatctgtcttcatcttcccgccatctgaagtatagtct

SEQ ID NO: 788885 - DNA, 446 bp, Homo sapiens
  misc_feature: NA.52.87.H10.1.454.light.4.multim50
ttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcattttgggtgttcgggcggagggaccaagttgaccgtcctaggtcagcccaaggcctcg

SEQ ID NO: 788886 - DNA, 467 bp, Homo sapiens
  misc_feature: NA.52.87.H10.3.454.light.4.multim50
ttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggaccacgactggagattaaacgaactgtggctgcaccatctgtcttcatcttccccg

SEQ ID NO: 788887 - DNA, 482 bp, Homo sapiens
  misc_feature: NA.52.87.H10.4.454.light.4.multim50
ttgggtttggggctgggcctcaggaagcagcatcgggggtgccgcagccatggcctggaccgctctccttctgagcctccttgctcactttacagggtctgcggcctcccatgacctgactcagtcactctcagtgtcggtggccctgggacagacggccactattacctgtgggggatacaacattggaactaaaaatgtgcagtggtaccagcagaagccaggccaggcccctgtgttggtcatctatagggatcgaagacgggcctctgggattcctgagcgattctctggctccaactcggagaacacggccaccctgaccatcagaagtgcccaagtcggtgatgaggcagactattactgccaggtgtgggacagtggtgttgtgatattcggcggagggaccaagctgaccgtcctaagtcagcccaaggctgccccctcggtcactctcgttcccaccctcctctatacgatcg

SEQ ID NO: 788888 - DNA, 437 bp, Homo sapiens
  misc_feature: NA.52.87.H10.6.454.light.4.multim50
ttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtccccctgtcctggtcatctatcaagatgtcaagcggccctcagggatccctgagcgattctctggctccaactctgggaacacagccactctgaccatcagcgggacccaggctatggatgaggctgactattactgtcaggcgtgggacagcaacactgtggtattcgggcggagggaccaagctgaccgtcctaggtcagcccaa

SEQ ID NO: 788889 - DNA, 505 bp, Homo sapiens
  misc_feature: NA.51.86.H09.1.454.light.4.multim50
ttgggtttgggatttagtgctatagacttgggtttggggctgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatacaaacgaactgtggctgcaccatctgtcttctatttccccg

SEQ ID NO: 788890 - DNA, 465 bp, Homo sapiens
  misc_feature: NA.49.30.C08.1.454.light.4.multim50
aagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaaccccactcgtctactctcg

SEQ ID NO: 788891 - DNA, 447 bp, Homo sapiens
  misc_feature: NA.49.30.C08.2.454.light.4.multim50
aagggaaagggggatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgttggggatttattactgcatgcaagctctacaagctcctcagctcactttcggcggagggaccaaggtggagatacaaacgaa

SEQ ID NO: 788892 - DNA, 440 bp, Homo sapiens
  misc_feature: NA.48.80.H03.3.454.light.4.multim50
aagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggagggaccaaggtcaccgtccta

SEQ ID NO: 788893 - DNA, 467 bp, Homo sapiens
  misc_feature: NA.49.30.C08.4.454.light.4.multim50
aagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtcttctatcttcccgccya

SEQ ID NO: 788894 - DNA, 441 bp, Homo sapiens
  misc_feature: NA.49.30.C08.5.454.light.4.multim50
aagggaaagggggagtcagacccagtcaggacacagcatggacatgagggtccccgctcagctcctggggctcctgctgctctggctcccaggtgccaaatgtgacatccagatgacccagtctccttcccttttgtctgcatctgttggagacagagtcaccatcacttgccgggccactgagaacattaatcgctggttggcctggtatcagcagaaaccagggaaagcccctgaggccctcatctatctggcgtctagtttagagagtggggtcccatcaagattcagcggcaatggatctgggacagaattcactctcaccattagcagcctgcagcctgatgatcttgcaacttattactgccaacattataatagttatatgtacatttttggccaggggaccaagttggagatcaaacgaactgtggctgcacc

SEQ ID NO: 788895 - DNA, 448 bp, Homo sapiens
  misc_feature: NA.41.37.D04.3.454.light.4.multim50
ttgggtttggggtctccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcacg

SEQ ID NO: 788896 - DNA, 489 bp, Homo sapiens
  misc_feature: NA.48.34.D01.11.454.light.4.multim50
ttgggtttggggagagaagagctgctcagttwggryyyrgrggragacmatgggtttrawycmsakyrcatgsktswctttyctsytgctaytyysrmtcycagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgta

SEQ ID NO: 788897 - DNA, 436 bp, Homo sapiens
  misc_feature: NA.17.29.C07.2.454.light.4.multim50
agggaaaggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctcctcctagtctacg

SEQ ID NO: 788898 - DNA, 475 bp, Homo sapiens
  misc_feature: NA.48.53.E09.3.454.light.4.multim50
ttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctcgttcccccctt

SEQ ID NO: 788899 - DNA, 443 bp, Homo sapiens
  misc_feature: NA.48.53.E09.5.454.light.4.multim50
ttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaasgtccg

SEQ ID NO: 788900 - DNA, 448 bp, Homo sapiens
  misc_feature: NA.48.53.E09.6.454.light.4.multim50
ttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtca

SEQ ID NO: 788901 - DNA, 484 bp, Homo sapiens
  misc_feature: NA.48.53.E09.7.454.light.4.multim50
ttgggtttggggtcagcttcagctgtggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagcccaaggctgccccctcggtccactcttccg

SEQ ID NO: 788902 - DNA, 436 bp, Homo sapiens
  misc_feature: NA.51.33.C11.2.454.light.4.multim50
ttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcacttcggcgggggaccaarggtggagatcaagcgaacktcgtggctgcta

SEQ ID NO: 788903 - DNA, 457 bp, Homo sapiens
  misc_feature: NA.51.33.C11.4.454.light.4.multim50
ttgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtggttcggcgggggaccgaagctgaccgtcctcggtcagcccaaggctcgccccctcggtcactc

SEQ ID NO: 788904 - DNA, 461 bp, Homo sapiens
  misc_feature: NA.51.33.C11.5.454.light.4.multim50
ttgggtttgggggaggaactgctcagttaggacccagagggaaccatggaagccccagctcagcttctcttcctcctgctactctggctcccagattccaccggagaaattgtgttgacacagtctccaggcaccctgtctttgtctccaggggaaagagccaccctctcctgcagggccagtcagagtgttagtcacttcttagcctggtaccaacacaaacctggccaggctcccaggctcctcatttatgatgcatccaagagggccactggcgtcccagccaggttcagtggcagtgggtctgggacagacttcactctcaccatcagcagcctagagcctgaagattttgcaatttattactgtcagcagcgtagcaattggcctccctcgatcaccttcggccaagggacacgactggagaataaacgaactgtggctgcaccatctgtcttcta

SEQ ID NO: 788905 - DNA, 471 bp, Homo sapiens
  misc_feature: NA.51.33.C11.6.454.light.4.multim50
ttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctcgccccctcggtcact

SEQ ID NO: 788906 - DNA, 451 bp, Homo sapiens
  misc_feature: NA.49.41.D08.1.454.light.4.multim50
ctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaaggcccccaaactcttcatttatgatgtcactaatcggccctcaggggtccctgatcgcttctctgcctccaagtctggcaacavcggcctccctgaccatctctgggctccaggctgaggatgaggctcatttattattgttgctcatatgcaggcaacttcgcttttgtcttcggaactgggaccgaggtcaccgtcctgggtcagcccaaggcccaacccc

SEQ ID NO: 788907 - DNA, 442 bp, Homo sapiens
  misc_feature: NA.49.41.D08.2.454.light.4.multim50
aggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtcttcta

SEQ ID NO: 788908 - DNA, 446 bp, Homo sapiens
  misc_feature: NA.49.41.D08.6.454.light.4.multim50
tgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 788909 - DNA, 328 bp, Homo sapiens
  misc_feature: NA.49.41.D08.9.454.light.4.multim50
ctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgaggtcaccgtcctgggtcagcccaaggccaaccccactgtcactctgttcccaccctcctctctctcgact

SEQ ID NO: 788910 - DNA, 446 bp, Homo sapiens
  misc_feature: NA.48.28.C06.1.454.light.4.multim50
tcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggcctgtccccccg

SEQ ID NO: 788911 - DNA, 432 bp, Homo sapiens
  misc_feature: NA.48.28.C06.2.454.light.4.multim50
ctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagccccgcggccg

SEQ ID NO: 788912 - DNA, 473 bp, Homo sapiens
  misc_feature: NA.48.28.C06.3.454.light.4.multim50
ctcgatttagtatctggrkagcytrgstktggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccccg

SEQ ID NO: 788913 - DNA, 449 bp, Homo sapiens
  misc_feature: NA.13.37.D04.2.454.light.4.multim50
ttgggtttgggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctccctgaccatctctgggctccaggctgaggatgagtctgattattactgctgctcatatgcaggcagctacactgtactagttcggcggagggaccaagctgacccgtcctaggtcacgaccccg

SEQ ID NO: 788914 - DNA, 452 bp, Homo sapiens
  misc_feature: NA.48.28.C06.5.454.light.4.multim50
ctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctsgt

SEQ ID NO: 788915 - DNA, 453 bp, Homo sapiens
  misc_feature: NA.48.28.C06.7.454.light.4.multim50
aagagctgctcagttaggacccagagggaaccatggaaaccccagcgcagcttctcttcctcctgctactctggctcccagatrccmccggagmamttgtgttgacgcagtctccagrcaccctgtctttgtctccaggggaragagccaccytctcctgcaggkccagtcagagtsttascrrcgrctmcktagcctggtaccakcagaaacstggccaggytcccaggctcctcatctaygrtgcatccagcagggccactggcatcccagacaggttcagtggcagtgggtctgggacagacttcactctcaccrtcagcagactggascctgaagattttgcagtgtattactgtcagcagtatggtagctcacctsawctcacckttcggccgragggacacragstggagatyaamcgaactgtggctgcaccatctgtcttctatt

SEQ ID NO: 788916 - DNA, 434 bp, Homo sapiens
  misc_feature: NA.48.28.C06.9.454.light.4.multim50
agtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccatttttacaaagtggagtctcatcaaggttcagcggcggtggatctggcacagatttcactctcaccatcagcagcctgcagcctgaagattttgcaacttattactgtctgcacgattacaattaccctcggacgttcggtccaacggaccgaaggtggaagtcaaacgaactagtggctgcaccta

SEQ ID NO: 788917 - DNA, 475 bp, Homo sapiens
  misc_feature: NA.13.55.E11.1.454.light.4.multim50
ttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataataaccggccctctgggatccctgaccgattctctggctccaactcggggaacacggccaccctgaccatcaacagagcccaagacggggatgaggctgactattattgtcaggtgtgggacagcaccacggtgatattcggcggcgggaccaagctgaccgtcctaggtcagcccaaggctgccccctcggtcactctgttcccgccctcctct

SEQ ID NO: 788918 - DNA, 478 bp, Homo sapiens
  misc_feature: NA.13.55.E11.2.454.light.4.multim50
ttgggtttggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaactcataatttatgatttcactaatcggccctcaggtgtatctaatcgcttcactggctccaagtctggcaacacggcctccctgaccatctctgggctccaggcagaggacgaggctgattattactgcggctcctggacgattagcaccctttatgtcttcgggactgtgaccaaggtcaccgtcctaggtcagcccaaggcccaccccactgtcactctgttcccccg

SEQ ID NO: 788919 - DNA, 443 bp, Homo sapiens
  misc_feature: NA.13.55.E11.4.454.light.4.multim50
ttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaactagtggctgcaccatctgtcttcta

SEQ ID NO: 788920 - DNA, 466 bp, Homo sapiens
  misc_feature: NA.13.55.E11.5.454.light.4.multim50
ttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggtccaacgggaccgaaggtggaaagtacaaacgaactagtggcgtgcaccatctgtcttctatcttccccg

SEQ ID NO: 788921 - DNA, 482 bp, Homo sapiens
  misc_feature: NA.43.37.D04.1.454.light.4.multim50
ttgggtttggttgggtttggggagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcagccccggctcgccccctcggt

SEQ ID NO: 788922 - DNA, 448 bp, Homo sapiens
  misc_feature: NA.51.45.E01.1.454.light.4.multim50
actgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggatgttggggtttattactgcgtgcaaagtctgcaaactatcaccttcggccaagggacacgactggagattaaacgaactgtggctgcacctatcg

SEQ ID NO: 788923 - DNA, 398 bp, Homo sapiens
  misc_feature: NA.51.45.E01.3.454.light.4.multim50
atcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggttcagtggcagtggatcaggcacagattttacactgacaatcaacagagtggaggctgaggatgttggggtttattactgcgtgcaaagtctgcaaactatcaccttcggccaagggacacgactggagattaaacgaactgtggctgcaccatctgtcttcatcttcccgccatctgatcgtagcact

SEQ ID NO: 788924 - DNA, 497 bp, Homo sapiens
  misc_feature: NA.3.33.C11.1.454.light.4.multim50
tttgggtttggggggggtctcaggaggcagcgctctcttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctcctcgagtgcgtcttcgac

SEQ ID NO: 788925 - DNA, 469 bp, Homo sapiens
  misc_feature: NA.43.38.D05.2.454.light.4.multim50
ttgggtttgggcacgaccggtgctcgatttagtatctgatagttgggtttgggggctttccctggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccgaagggaccagggtggaaagtcaaacgaactgtggctgcaccatctgtcttctatcttcccgccactctgtaa

SEQ ID NO: 788926 - DNA, 343 bp, Homo sapiens
  misc_feature: NA.48.55.E11.8.454.light.4.multim50
ttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 788927 - DNA, 462 bp, Homo sapiens
  misc_feature: NA.40.73.G07.2.454.light.4.multim50
agggcacgaccggtgctcgatttagagtgagctcgttggggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtccccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggt

SEQ ID NO: 788928 - DNA, 500 bp, Homo sapiens
  misc_feature: NA.40.73.G07.3.454.light.4.multim50
agggcacgaccggtgctcgatttagtacacgtgattagggaagggggaagagctgctcagttaggacccagagggaaccatggaaaccccagcgcaacttctcttcctcctgctactctggctcccagawaccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccgaaggtggagatcaaacgaactgtggctgcaccatctgtcttcatcttcccgcta

SEQ ID NO: 788929 - DNA, 464 bp, Homo sapiens
  misc_feature: NA.40.73.G07.4.454.light.4.multim50
taagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccgcat

SEQ ID NO: 788930 - DNA, 462 bp, Homo sapiens
  misc_feature: NA.40.73.G07.6.454.light.4.multim50
agggcacgaccggtgctcgatttagacgacagctcaggggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcagtggatcaggtacagattttacactagaaaatcagcagagtggaggctggaggatggttggggtttattactgcatgcaagctctacaaattcctcggacgttcggtccgaacggaccgaaac

SEQ ID NO: 788931 - DNA, 469 bp, Homo sapiens
  misc_feature: NA.49.24.C02.1.454.light.4.multim50
tagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactcgtcactctcgttcccccg

SEQ ID NO: 788932 - DNA, 498 bp, Homo sapiens
  misc_feature: NA.49.24.C02.2.454.light.4.multim50
tagggaagggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttctggggtccctgatcgcttctctggctccatccttgggaacaaagctgccctcaccatcacgggggcccaggcagatgatgaatgtgattattactgtgtgctgtatctgggtggtggtctttttcgtgttcggcggagggaccaagctgaccgtcctacgtcagcccaaggctcgccccctcggt

SEQ ID NO: 788933 - DNA, 463 bp, Homo sapiens
  misc_feature: NA.49.24.C02.3.454.light.4.multim50
tagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtcttcatcttcccgt

SEQ ID NO: 788934 - DNA, 453 bp, Homo sapiens
  misc_feature: NA.49.24.C02.4.454.light.4.multim50
tagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccggggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcta

SEQ ID NO: 788935 - DNA, 470 bp, Homo sapiens
  misc_feature: NA.3.37.D04.1.454.light.4.multim50
ttgggtttggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgatgtcaataatcggccctcaggggtttctaatcgcttctctggctccaagtctggcaacacggcctccctgaccatctctgggctccagggtgaggacgaggctgattattactgcagctcatttacaagcagcaccactcaggtcttcggaactgggactaaggtcaccgtcctaggtcagcccaaggccaaccccactgtcactccg

SEQ ID NO: 788936 - DNA, 464 bp, Homo sapiens
  misc_feature: NA.3.37.D04.2.454.light.4.multim50
ttgggtttgggggatcaggactcctcagttcaccttctcacaatgaggctccctgctcagctcctggggctgctaatgctctgggtctctggatccagtggggacattgtcatgactcagtctccactctccctggccgtcacacctggagagacggcctccatctcctgcaggtctagtgagagcgtccagggtaatggatacgactatttggattggtacctgcagaagccagggcagcccccacaactcctgatctacttggcttctaatcgggcctccggggtccctgacaggttcagcggcagtggatcaggcacagattttaaactgataatcagccgcgtggaggctgaggatgttgggatttattactgcgtgcaagttcgacaaaccccattcactttcggccctgggaccaaagtggacatcaaacgaactgtggctgcaccatctgtcttcta

SEQ ID NO: 788937 - DNA, 479 bp, Homo sapiens
  misc_feature: NA.3.37.D04.3.454.light.4.multim50
ttkgggtttggggggggtctcaggaggcagcgctctcgggacgtctccaccatggcctgggctctgctattcctcaccctcctcactcagggcacagrgtcctgggcccagyctgccctgactcagcctgcctccgtgtctgggtctcctggacagtcgrtcaccatctcctgcactggawccamcrgtgacgttgmtayttwtaagtwtstctcstskwcctggtaccaamaacacccaggcaaagcccccaraytmatsatttatgatgtcastgmtcggccctcaggggtttctcatcgcttttctggctccaagtctggcamcacggcctccctgaccatctckgggctccaggctgaggacgaggctgmttattwctgcagctcatayacaassrgcaccactstcgtggtwttyggtggagggaccaaggctgaccgtcctaggtcagcccaaggctgccccctcggtcactc

SEQ ID NO: 788938 - DNA, 461 bp, Homo sapiens
  misc_feature: NA.51.37.D04.8.454.light.4.multim50
ttgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacaggcgacactgccgtggttcggcgggggaccgaagctgaccgtcctcggtcassccaaggctcgccccctcggtcacttccg

SEQ ID NO: 788939 - DNA, 452 bp, Homo sapiens
  misc_feature: NA.48.68.G02.5.454.light.4.multim50
aggaactgctcagttaggacccagacggaaccatggaagccccagcgcagcttctcttcctcctgctactctggctcccagatgtcactggagaaaaataatgacgcagtctccagcccccctgcctgtgtctccaggggaaagagccaccctctcctgcagggccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagattttgctattttattactgtcagcactataataactggccacgtggacgttcggccaagggaccaaggtggaaatcaaacgaactgtggctgcacc

SEQ ID NO: 788940 - DNA, 448 bp, Homo sapiens
  misc_feature: NA.48.68.G02.6.454.light.4.multim50
agagctctggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccgaaggtggagatcaaacgaactgtggctgcaccat

SEQ ID NO: 788941 - DNA, 464 bp, Homo sapiens
  misc_feature: NA.43.37.D04.2.454.light.4.multim50
ttgggtttgggggaagagctgctcagttaggacccagagggaaccatggaaaccccagcgcagcttctcttcctcctgctactctggctcccagatrccmccggagaaattgtgttgacrcagtctccagrcaccctgtctttgtctccaggggamagagscaccytctcctgcaggkccagtcagastgttagcagcagcwrcttagcctggtaccagcagaaacctggccaggctcccaggctcctcatctatggtrcatccarcagggccactggcatmccagacaggttcagtggcagygggtctgggacagacttcactctcaccatcagcagactggagcctgaagattttgcagtgtattactgtcagcagtatggtagctcacmgaggacgttcggccaagggaccgaaggtaggaaatcaaacgaactgtggctgcaccatctgtcttcattccc

SEQ ID NO: 788942 - DNA, 506 bp, Homo sapiens
  misc_feature: NA.40.53.E09.2.454.light.4.multim50
ttgggtttggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtggttcggcggggggaccgaagctgaccgtcctaagtcagcccaaggctgccccctcggtcactctgttccsrccctcctcagtcgctaga

SEQ ID NO: 788943 - DNA, 454 bp, Homo sapiens
  misc_feature: NA.40.53.E09.3.454.light.4.multim50
ttgggtttgggcacgaccggtgctcgatttagagagagtgtgttgggtttgggggccgttcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtgttcggcgggggaccaagctgaccgtcctaagtcagcccaaggctgccccctcggtcactctgttcccaccctcctcagtcgctaka

SEQ ID NO: 788944 - DNA, 450 bp, Homo sapiens
  misc_feature: NA.49.53.E09.5.454.light.4.multim50
tttgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgactttttggccaggggaccaagctggagatcaagcgaactgtggctgcaccatctgtt

SEQ ID NO: 788945 - DNA, 454 bp, Homo sapiens
  misc_feature: NA.40.53.E09.5.454.light.4.multim50
ttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaa

SEQ ID NO: 788946 - DNA, 466 bp, Homo sapiens
  misc_feature: NA.40.53.E09.6.454.light.4.multim50
ttgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctggggacagccttcactctcaccatcagcagcctggagcccgaagattttgcggttttattactgtcagcagcgtgccgactggccccctcacgttcggcggagggaccaaggtggacatcaaacgaactgtggctgcaccatctgtcttcatcttcccgc

SEQ ID NO: 788947 - DNA, 484 bp, Homo sapiens
  misc_feature: NA.48.77.G11.3.454.light.4.multim50
aagggaaaggggtggtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatcctaattgggtcttcggcggagggaccaagttgaccgtcctaagtcagcccaaggcctgccccctcggtcactctgttcccgacct

SEQ ID NO: 788948 - DNA, 472 bp, Homo sapiens
  misc_feature: NA.48.77.G11.4.454.light.4.multim50
aagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgsttatmactatgtctcctggtaccaacagcacccwggcaaagcccccaaactcatgatttatgatrtcactaagcggccctcaggggtccctgatcgcttctctggctccmagtctggcaacacggcctccctgaccatctctgggctccaggctgargatgaggctgattattactgctgctcatatgcaggcagctacacttttggtsttcggcrgagggaccaaggtccaccgtcctaggtcagcccaaggccaaccccactgtcact

SEQ ID NO: 788949 - DNA, 438 bp, Homo sapiens
  misc_feature: NA.49.78.H01.3.454.light.4.multim50
agctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagacgtgaagatgtggcagtgtattactgtcagcaatatcacactgctccgctcactttcggcggagggaccgagggtggagatacaaacgtaack

SEQ ID NO: 788950 - DNA, 493 bp, Homo sapiens
  misc_feature: NA.48.77.G11.6.454.light.4.multim50
aagggaaagggggggragsswarskgkgctgtgggtccaggaggcagaactctgggtgtctcaccatggcctgggtccccctacttctccccctcctcactctctgcacaggctctcaggcctcctatgagttgacacagccaccctcggtgtcagtgtccccaggacagacggccaggatcacctgctctggagatggattgccaacacaatatgcgtactggtaccagaagaagccaggccaggcccctgttttggtgatatatcaagacactcagagggcctcagggacccctgagcggttctctggctccagctcaggggcaacagtcgcgttgacaatcagggaagtccaggcagaggacgaggctgactattactgtcagtctgcagacaacggaggtacttacttggtcttcggcggtagggaccaagttgaacgtcctagggtcagcccaaggctgccccctcggtcacgtctgttcccaccctt

SEQ ID NO: 788951 - DNA, 461 bp, Homo sapiens
  misc_feature: NA.48.77.G11.7.454.light.4.multim50
aagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttgggggtttattactgcatgcaagctctacaaactcctcgggcgttcgscracgggaccgaaggtaggaaagtacgaaacgaaacgtagtaggcgt

SEQ ID NO: 788952 - DNA, 442 bp, Homo sapiens
  misc_feature: NA.49.78.H01.4.454.light.4.multim50
aggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccgaaggtggagatcaaacgaactgtggctgcaccatctgttt

SEQ ID NO: 788953 - DNA, 494 bp, Homo sapiens
  misc_feature: NA.8.34.D01.1.454.light.4.multim50
ttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaaagtggatatcaaacgaactgtggctgcaccatctgtcttctatcttcccgccatctgtagacacgcgag

SEQ ID NO: 788954 - DNA, 494 bp, Homo sapiens
  misc_feature: NA.41.35.D02.1.454.light.4.multim50
ttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggtcactctgttcccrccctcctcatagtataga

SEQ ID NO: 788955 - DNA, 481 bp, Homo sapiens
  misc_feature: NA.41.30.C08.2.454.light.4.multim50
aagggaaaggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggbggttataactatgtctcctggtaccaacavcacccaggcaaagcccccaaactcataatttatgaggtcagtaagcggccctcaggggtttctgatcgcttctctggctccaagtctggcaacacggcctccctgacagtctctgggctccaggctgaggacgaggctgattactactgctbctcatatgcaggyagtavbaaktyctgggtgttcggcggagggaccaagctgaccgtcctgggtcagcccaaggctgccccctcggtcactctgttcccyr

SEQ ID NO: 788956 - DNA, 454 bp, Homo sapiens
  misc_feature: NA.49.15.B04.2.454.light.4.multim50
tccgcgggcacgaccggtgctcgatttagatcgtcgatcgaagggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggacggagggact

SEQ ID NO: 788957 - DNA, 442 bp, Homo sapiens
  misc_feature: NA.41.35.D02.3.454.light.4.multim50
ttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcacca

SEQ ID NO: 788958 - DNA, 495 bp, Homo sapiens
  misc_feature: NA.41.35.D02.5.454.light.4.multim50
ttgggtttgggggtgctcgattagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtgggtcccatcaaggttcagcggcagtggatctgggacacatttcactctcactatcagcagcctgcagcctgaggtattttgcgtacttactattgtctaacaggctgactacgtttaccctcttcctacgtttcggckrmgggaccaggtkgasmsyaaasgrttcgaagtacccaaaacggaacctta

SEQ ID NO: 788959 - DNA, 442 bp, Homo sapiens
  misc_feature: NA.4.39.D06.2.454.light.4.multim50
cagttctttggggagactcagtcaggacacagcatggacatgagggtccccgctcagctcctggggctcctgctgctctggctcccaggtgccgagggtgacgatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttcggccaggggaccaaggtcgaaatgagacgaactgtggctgcaccatctgtt

SEQ ID NO: 788960 - DNA, 458 bp, Homo sapiens
  misc_feature: NA.49.15.B04.3.454.light.4.multim50
tccgcgggcacgaccggtgctcgatttagagctcacgtattgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttattactgtcagcagtataatgtccgggctccggacactttcggcggagggaccaaga

SEQ ID NO: 788961 - DNA, 446 bp, Homo sapiens
  misc_feature: NA.49.85.H08.2.454.light.4.multim50
tcgcggksgmgksagtcccaaccaggacacagcatggacatgagggtccctgctcagctcctggggctcctgctgctctggctctcaggtgccagatgtgacatccggatgacccagtctccatcctccctgtcygcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtctt

SEQ ID NO: 788962 - DNA, 468 bp, Homo sapiens
  misc_feature: NA.49.85.H08.3.454.light.4.multim50
tcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattaytgcksytcatatrccggwrayaryrrcmkwwgggtgttcggcggagggaccaagstgaccgtcctaggtcagcccaaggctcgccccctcggtctacc

SEQ ID NO: 788963 - DNA, 449 bp, Homo sapiens
  misc_feature: NA.49.57.F02.1.454.light.4.multim50
ttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccgagggtggagatcaaacgtaacg

SEQ ID NO: 788964 - DNA, 463 bp, Homo sapiens
  misc_feature: NA.49.57.F02.4.454.light.4.multim50
ttgggtttgggggtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgttttcggcggagggaccaggctgaccgtcctgggtcagcccaaggctgccccctcggtcactcttccg

SEQ ID NO: 788965 - DNA, 473 bp, Homo sapiens
  misc_feature: NA.49.57.F02.5.454.light.4.multim50
ttgggtttgggctcgttggggtttggggggagggaactgctcagttaggacccagacggaaccatggaagccccagcgcagcttctcttcctcctgctactctggctcccagataccactggagaaatagtgatgacgcagtctccagccaccctgtctgtgtctccagggggaaagagtcaccctctcctgcagggccagtcagagtgttaggagcaacttagcctggtatcagcagaaacctggccaggctcccaggctcctcatctatggtgcatccaccaggggccactggtatcccagccaggttcagtggcagtgggtctgggacagagttcactctcaccatcagcagcctgcagtctgaagattttgctagtttattactgttcagcagtataatgtccgggctccggacactttcggcggasgggaccaagggtggagatacaaacgaactgtggctgcaccat

SEQ ID NO: 788966 - DNA, 444 bp, Homo sapiens
  misc_feature: NA.49.57.F02.6.454.light.4.multim50
ttgggtttgggggctgtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcmkcagacagyagtggcasttmtgtcgtattcggcggagggacyacrgctgaccgtcctaggtcagcccaac

SEQ ID NO: 788967 - DNA, 499 bp, Homo sapiens
  misc_feature: NA.49.57.F02.7.454.light.4.multim50
ttgggtttgggggctggggtctcaggaggcagcgctctcgggacgtctccaccatggcctgggctctgctattcctcaccctcctcactcagggcacagggtcctgggccywgkstkysskgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgacccatctctgggctccaggctgaggacgaggctgattattactgcagctcatatacaaaacataaacacttgggtgttcggcggcgggaccaaactgaccgtcctacgtcagcccaaggctgccccyyggtcactctcgttcccaccctcctctctctcgact

SEQ ID NO: 788968 - DNA, 450 bp, Homo sapiens
  misc_feature: NA.49.59.F04.1.454.light.4.multim50
tagggattgggggagtcagacccagtcaggacacagcatggacatgagggtccccgctcagctcctggggctcctgctgctctggctcccaggtgccaaatgtgacatccagatgacccagtctccttccaccctgtctgcatttgtaggagacagagtcaccatcacttgccgggccagtcagagtattagtagccggttggcctggcatcagcagaaacccgggaaagcccctaagctcctgatatatgaggcgtccagtttagaaagtggggtcccatcaaggttcagcggcagtggatctgggacagagttcactctcaccatcagcagcctgcagcctgatgattttgcaacttattactgccaacagtataatagttattcgtatacttttggccaggggaccaagctggagatcaaacgaactgtggctgcaccatctgtttc

SEQ ID NO: 788969 - DNA, 474 bp, Homo sapiens
  misc_feature: NA.49.59.F04.2.454.light.4.multim50
tagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctcgccccctcggtcactctcgttcccaccctt

SEQ ID NO: 788970 - DNA, 460 bp, Homo sapiens
  misc_feature: NA.41.12.B01.3.454.light.4.multim50
tccgcgggcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgctagtttattactgtcaccaatataataactggtacacttttggccaggggaccaagctcgagatcaaacgaa

SEQ ID NO: 788971 - DNA, 447 bp, Homo sapiens
  misc_feature: NA.3.71.G05.1.454.light.4.multim50
cagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtcactctccgcg

SEQ ID NO: 788972 - DNA, 447 bp, Homo sapiens
  misc_feature: NA.51.29.C07.2.454.light.4.multim50
agggaaagggggaatcagtcccactcaggacacagcatggacatgagggtccccgctcagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaagcccctacgcgccttaactatgttacattcagtttgcaaagtggcgtcccatcaaggtccagcggcattggatctggggcagaattcactctcacattcagcagcctgcagcctgaagatttttcaacttataagtgtctacatcataattcttggaggagatcacacgttggaactgtggctgcaccatctgtcttcatcttcccgccatctgatcgt

SEQ ID NO: 788973 - DNA, 458 bp, Homo sapiens
  misc_feature: NA.48.73.G07.4.454.light.4.multim50
  modified_base (451)..(451): a, c, t, g, unknown or other
agggcacgaccggtgctcgatttagctascgactgytagggaaaggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaastcatgatttatgatatcactaagcggccctcagggtccctgatcgcttctctggctccmagtctggcaacacggcctccctgaccatctctgggctccaggctgaggatgaggctgattattactgctgctcatatgcaggcagcwacwaygtggattcggcggngggaacc

SEQ ID NO: 788974 - DNA, 458 bp, Homo sapiens
  misc_feature: NA.51.29.C07.1.454.light.4.multim50
aagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccaaggtggaaatgaaaggaactgtggctgcaccatctgtcttcta

SEQ ID NO: 788975 - DNA, 451 bp, Homo sapiens
  misc_feature: NA.48.26.C04.2.454.light.4.multim50
aggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgcc

SEQ ID NO: 788976 - DNA, 432 bp, Homo sapiens
  misc_feature: NA.49.78.H01.6.454.light.4.multim50
agtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggbcgggggaccaaggtggagatcaagacgaactggtggctgcaccta

SEQ ID NO: 788977 - DNA, 498 bp, Homo sapiens
  misc_feature: NA.48.26.C04.1.454.light.4.multim50
cacgaccggtgctcgatttagtctagcgactttgggtttggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcgccccctcggtata

SEQ ID NO: 788978 - DNA, 478 bp, Homo sapiens
  misc_feature: NA.40.42.D09.2.454.light.4.multim50
agggaaagggggggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcactctgttcccaccctcctcagtcgctaga

SEQ ID NO: 788979 - DNA, 467 bp, Homo sapiens
  misc_feature: NA.48.34.D01.1.454.light.4.multim50
tttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgccta

SEQ ID NO: 788980 - DNA, 449 bp, Homo sapiens
  misc_feature: NA.48.34.D01.2.454.light.4.multim50
ttgggtttggggagagctgctcagttaggacccagagggaaccatggaaaccccagcgcagcttctcttcctcctgctactctggctcccagataccaccggagcacttgtgttgacgcagtctccaggcaccctgtctttgtctccaggggagagagcccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatacaaacgaactgtggctgcacc

SEQ ID NO: 788981 - DNA, 471 bp, Homo sapiens
  misc_feature: NA.48.34.D01.3.454.light.4.multim50
ttgggtttggggtgggttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctcgccccccg

SEQ ID NO: 788982 - DNA, 463 bp, Homo sapiens; identical to SEQ ID NO: 788729
  misc_feature: NA.48.34.D01.6.454.light.4.multim50

SEQ ID NO: 788983 - DNA, 470 bp, Homo sapiens
  misc_feature: NA.48.29.C07.7.454.light.4.multim50
agggaaaggggggaggaactgctcagttaggacccagacggaaccatggaagccccagcgcagcttctcttcctcctgctactctggctcccagatgtcactggagaaaaataatgacgcagtctccagcccccctgcctgtgtctccaggggaaagagccaccctctcctgcagggccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagtattttgcattttattactgtcagcactataataactggccacgtggacgttcggccaagggaccaaggtggaaatacaaacgaactagtggcgtgcaccta

SEQ ID NO: 788984 - DNA, 485 bp, Homo sapiens
  misc_feature: NA.41.33.C11.2.454.light.4.multim50
ttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctcgccccctcggtcactctcgttccccg

SEQ ID NO: 788985 - DNA, 482 bp, Homo sapiens
  misc_feature: NA.41.33.C11.3.454.light.4.multim50
ttgggtttggggctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccgccctcctcta

SEQ ID NO: 788986 - DNA, 441 bp, Homo sapiens
  misc_feature: NA.49.28.C06.4.454.light.4.multim50
ctgtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgagggctgactattactgtcagtcatcagaacagtagtggctacttctgtcgtattcggcggaggggaccaagctgaccgtcctaggtcagcccgaasgctccc

SEQ ID NO: 788987 - DNA, 462 bp, Homo sapiens
  misc_feature: NA.48.57.F02.8.454.light.4.multim50
ttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaaggctgaccgtcctaggtcagcccaaggctgccccctcc

SEQ ID NO: 788988 - DNA, 354 bp, Homo sapiens
  misc_feature: NA.49.87.H10.7.454.light.4.multim50
ttgggtttkgggtytgcatskgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 788989 - DNA, 359 bp, Homo sapiens
  misc_feature: NA.19.10.A10.2.454.light.4.multim50
aggggggagaagagctgctcagttaggacccagagggaaccatggaaaccccagcgcagcttctcttcctcctgctactctggctcccagatagcaccggagaaattttcttgacgcagtctccaggcaccctgtctttgaccactggcatccccgacaggttcagtggcagtgtgtctgggacagacttcactctcaccatcagcagactggagcctgaagattttgcagtgtattactgtcaacgatatgatgagtcacctccgtggtggacatttggccaggggaccaaggttgaagtcaaacgaactgtggctgcaccatctgtcttcatcttcccgccatctgacacgagagta

SEQ ID NO: 788990 - DNA, 452 bp, Homo sapiens
  misc_feature: NA.49.34.D01.2.454.light.4.multim50
tttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 788991 - DNA, 450 bp, Homo sapiens
  misc_feature: NA.49.34.D01.4.454.light.4.multim50
ttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaaaccgtaacg

SEQ ID NO: 788992 - DNA, 478 bp, Homo sapiens
  misc_feature: NA.49.34.D01.7.454.light.4.multim50
ttgggtttgggggctgtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctacggtcagcccaacggctagccccctcggtcactctgttcccacsct

SEQ ID NO: 788993 - DNA, 449 bp, Homo sapiens
  misc_feature: NA.49.34.D01.8.454.light.4.multim50
ttgggtttgggggctgtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaaggctccg

SEQ ID NO: 788994 - DNA, 481 bp, Homo sapiens
  misc_feature: NA.49.34.D01.9.454.light.4.multim50
ttgggtttgggggctgtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccagggtggaggatggaaggtgactactattgttactcaccagacaccagtagaaaatcacagaggaatattcggcggagggaccaagctgaccgtcctaggtcagmccaaggcyygccccctcggtccactctcgttcccka

SEQ ID NO: 788995 - DNA, 470 bp, Homo sapiens
  misc_feature: NA.8.33.C11.1.454.light.4.multim50
tttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaactgtggctgcaccatctgtcttctatt

SEQ ID NO: 788996 - DNA, 460 bp, Homo sapiens
  misc_feature: NA.43.37.D04.4.454.light.4.multim50
ttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacyacggtcaccgtcctaggtcagcccaaggccaaccccca

SEQ ID NO: 788997 - DNA, 459 bp, Homo sapiens
  misc_feature: NA.43.37.D04.5.454.light.4.multim50
ttgggtttggggagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtaggaaatacaaacgaactagtggctgcaccatctgtcttcatcttcccgt

SEQ ID NO: 788998 - DNA, 483 bp, Homo sapiens
  misc_feature: NA.43.37.D04.6.454.light.4.multim50
ttgggtttgggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattaactgtcaacagtataatagttacccctggaacgttcggtcsaasggamcgamgggkwggaaagtacaaacgaaactacgtaggcgtgcgaccaactmctgtctttctactctttcccccg

SEQ ID NO: 788999 - DNA, 464 bp, Homo sapiens
  misc_feature: NA.43.37.D04.7.454.light.4.multim50
ttgggtttggggggggtcwcargaggcagcgctctcrggacgtcwccaccatggcctgggctctgctsctcctcacyctcctcrctcaggrcacagggtcctgggcccagtctgccctgactcagcctscctccgygtcygggtcycctggacagtcrrtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtcctaggtcagcccaaggctcgccccctcggt

SEQ ID NO: 789000 - DNA, 458 bp, Homo sapiens
  misc_feature: NA.43.37.D04.8.454.light.4.multim50
ttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcaggggtggaggctgaggattggttggggtttattactgcatgcaaggtacacactcggcccgtcaccttcggccaagggacacgactggagattaaacgaactgtggctgca

SEQ ID NO: 789001 - DNA, 453 bp, Homo sapiens
  misc_feature: NA.51.38.D05.2.454.light.4.multim50
ttgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagcccaaggctgccccctcggtcact

SEQ ID NO: 789002 - DNA, 438 bp, Homo sapiens
  misc_feature: NA.51.38.D05.3.454.light.4.multim50
ttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccgaaggtggagatcaagcgaactgtggcgt

SEQ ID NO: 789003 - DNA, 459 bp, Homo sapiens
  misc_feature: NA.51.38.D05.4.454.light.4.multim50
ttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactgtcact

SEQ ID NO: 789004 - DNA, 459 bp, Homo sapiens
  misc_feature: NA.49.78.H01.1.454.light.4.multim50
ctgtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgtttttcggcggagggaccaggctgaccgtcctgggtcagccaaggctgcccctcggtcactctgttcccaccct

SEQ ID NO: 789005 - DNA, 453 bp, Homo sapiens
  misc_feature: NA.49.78.H01.2.454.light.4.multim50
aggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgtcttcattcccg

SEQ ID NO: 789006 - DNA, 480 bp, Homo sapiens
  misc_feature: NA.49.78.H01.8.454.light.4.multim50
ctgtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtagaaaatcaacagaggaaatagttcggacggagggaccaagctgaccgtcctaggtcarcccaaggctgccccctcggtccactctcgttcccgcctcytctctcc

SEQ ID NO: 789007 - DNA, 469 bp, Homo sapiens
  misc_feature: NA.40.35.D02.1.454.light.4.multim50
tttgggtttgggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatggtgggggtgccacgttgggtgttcggcggagggaccaagctgaccgtcctaggtcagcccaaggctcgccccctccgg

SEQ ID NO: 789008 - DNA, 481 bp, Homo sapiens
  misc_feature: NA.40.35.D02.3.454.light.4.multim50
ttgggtttgggggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggagggaccaagctgaccgtcctaggtcagcccaaggctcgccccctcggtcactctcgttcccaccctcctc

SEQ ID NO: 789009 - DNA, 466 bp, Homo sapiens
  misc_feature: NA.40.35.D02.4.454.light.4.multim50
ttgggtttgggggaagagcttctcagttaggacccagagggaaccatggaaaccccagcgcagcttctcttcctcctgctactctggctcccagatgccaccggagaaattgtgttgacgcagtctccaggtaccctgtctttgtctccaggggaaagagccaccctctcctgcagggccagtcagagtattaggaacactgtccaaggctggtatcagcataaacctggccaggctcccaggctcctcatctatgagacgtccaggagggccagtggcatcccagacaggttcagtggcagtgggtctgggaccgacttcactctaaccatcagtagactggaacctgaagactctgcagtgtattactgtcaacactttgaaggcccacttatcacattcggcggagggaccaaggtggaggatcaagcgaactgtggctgcaccatctgtcttcatcttcccg

SEQ ID NO: 789010 - DNA, 482 bp, Homo sapiens
  misc_feature: NA.49.38.D05.2.454.light.4.multim50
ttgggtttgggggctgtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctcgccccctcggtcactctgttcccaccctcct

SEQ ID NO: 789011 - DNA, 451 bp, Homo sapiens
  misc_feature: NA.49.38.D05.3.454.light.4.multim50
ttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 789012 - DNA, 496 bp, Homo sapiens
  misc_feature: NA.49.38.D05.4.454.light.4.multim50
ttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacgtaactgtggctgcaccatctgtcttcatcttcccgccatctgatctctcgact

SEQ ID NO: 789013 - DNA, 452 bp, Homo sapiens
  misc_feature: NA.49.38.D05.5.454.light.4.multim50
ttgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttattactgtcagcagtataattactggcytcgcaytttyggccaggggaccaaggctggagatcaagcgaactgtggctgcaccatctgtt

SEQ ID NO: 789014 - DNA, 472 bp, Homo sapiens
  misc_feature: NA.49.38.D05.6.454.light.4.multim50
ttgggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttcccaccctt

SEQ ID NO: 789015 - DNA, 478 bp, Homo sapiens
  misc_feature: NA.48.42.D09.1.454.light.4.multim50
agggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaraagtgtgcactggtaccagcagaagccaggccaggcccctgtgctggtcgtctttgatgataccgaccggccctcagggatccctgagcgaktckctggctccaactctgksaacacggccaccctgrccatcagcagggtcgaagccggggatgaggccgactattactgtcaggtgtgggatartrgtrgtgatcatcctaattgggtsttcggcggagggaccaagctgaccgtcctargtcagcccaaggctgccccctcggtcactctgttccctacct

SEQ ID NO: 789016 - DNA, 461 bp, Homo sapiens
  misc_feature: NA.48.42.D09.2.454.light.4.multim50
agggaaaggggctgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggccgacggaccgaacggtaggaagtacgaaacgaacgtagtggcgtcg

SEQ ID NO: 789017 - DNA, 456 bp, Homo sapiens
  misc_feature: NA.48.42.D09.3.454.light.4.multim50
agggaaaggggagagctctggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcacc

SEQ ID NO: 789018 - DNA, 459 bp, Homo sapiens
  misc_feature: NA.48.42.D09.5.454.light.4.multim50
agggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttccccg

SEQ ID NO: 789019 - DNA, 463 bp, Homo sapiens
  misc_feature: NA.48.42.D09.7.454.light.4.multim50
agggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggctagtttattactgtacaacaatattattatactccgccgacgttcggccgggggaccaacgtmggaawwcaaacgaactgtggctgcaccat

SEQ ID NO: 789020 - DNA, 450 bp, Homo sapiens
  misc_feature: NA.48.42.D09.8.454.light.4.multim50
agggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggtacgttcggccgtacggggacccgaaasgtmggaagtgtacaaccgaaactagtggctggcaccta

SEQ ID NO: 789021 - DNA, 463 bp, Homo sapiens
  misc_feature: NA.5.12.B01.1.454.light.4.multim50
tccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgtcctgagtcagcccaaggctccgkccccccg

SEQ ID NO: 789022 - DNA, 440 bp, Homo sapiens
  misc_feature: NA.5.12.B01.2.454.light.4.multim50
tccgcggggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagcccaaggctgccccctcggtcactctcgttcccgccctcctccgtgtctgat

SEQ ID NO: 789023 - DNA, 552 bp, Homo sapiens
  misc_feature: NA.48.14.B03.1.454.light.4.multim50
tccgcggggagggggtcaggctggaactgaggagcaggtgggggcacttctccctctaacactctcccctgttgatccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaaacgaactagtggctgcaccatctgtcttcatcttccccg

SEQ ID NO: 789024 - DNA, 463 bp, Homo sapiens
  misc_feature: NA.51.35.D02.2.454.light.4.multim50
ttgggtttgggggaggaactgctcagttaggacccagagggaaccatggaagccccagctcagcttctcttcctcctgctactctggctcccagattccaccggagaaattgtgttgacacagtctccaggcaccctgtctttgtctccaggggaaagagccaccctctcctgcagggccagtcagagtgttagtcacttcttagcctggtaccaacacaaacctggccaggctcccaggctcctcatttatgatgcatccaagagggccactggcgtcccagccaggttcagtggcagtgggtctgggacagacttcactctcaccatcagcagcctagagcctgaagattttgcaatttattactgtcagcagcgtagcaattggcctccctcgatcaccttcggccaagggacacgactggagaataaacgaactgtggctgcaccatctgtcttctatt

SEQ ID NO: 789025 - DNA, 468 bp, Homo sapiens
  misc_feature: NA.51.35.D02.4.454.light.4.multim50
ttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatacaaacgaactgtggctgcaccatctgtctttat

SEQ ID NO: 789026 - DNA, 451 bp, Homo sapiens
  misc_feature: NA.51.35.D02.5.454.light.4.multim50
ttgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccgaagctgaccgtcctcggtcagcccaaggctgccccctccggt

SEQ ID NO: 789027 - DNA, 475 bp, Homo sapiens
  misc_feature: NA.51.87.H10.1.454.light.4.multim50
tttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaatacccmggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctcgccccctcggtcactctgtt

SEQ ID NO: 789028 - DNA, 458 bp, Homo sapiens
  misc_feature: NA.51.87.H10.2.454.light.4.multim50
ttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcagcatcacttgccgggccactgagaatattcataattggttggcctggtatcagcagaaaccagggaaagcccctaaactcctgatatataagacgtctaatttagaaggtggggtcccatcaaggttcagcggcggtggctctgggacagaattcactctcaccatcaccagcctgcagcctgatgattttgcaacttattactgccaacagtattatagttattggacgttcggccaagggaccaaggtggaaatcaaacgaactgtggctgcaccatctgtcttcatcttccccg

SEQ ID NO: 789029 - DNA, 468 bp, Homo sapiens
  misc_feature: NA.51.87.H10.4.454.light.4.multim50
ttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatacaaacgaactgtggctgcaccatctgtcttcat

SEQ ID NO: 789030 - DNA, 435 bp, Homo sapiens
  misc_feature: NA.51.87.H10.5.454.light.4.multim50
ttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccgaaggtggagatcaagcgaactgtggctgca

SEQ ID NO: 789031 - DNA, 462 bp, Homo sapiens
  misc_feature: NA.51.87.H10.6.454.light.4.multim50
ttgggtttggggaggaactgctcagttaggacccagagggaaccatggaagccccagctcagcttctcttcctcctgctactctggctcccagattccaccggagaaattgtgttgacacagtctccaggcaccctgtctttgtctccaggggaaagagccaccctctcctgcagggccagtcagagtgttagtcacttcttagcctggtaccaacacaaacctggccaggctcccaggctcctcatttatgatgcatccaagagggccactggcgtcccagccaggttcagtggcagtgggtctgggacagacttcactctcaccatcagcagcctagagcctgaagattttgcaatttattactgtcagcagcgtagcaattggcctccctcgatcaccttcggccaagggacacgactggagaataaacgaactgtggctgcaccatctgtcttctatt

SEQ ID NO: 789032 - DNA, 458 bp, Homo sapiens
  misc_feature: NA.51.87.H10.7.454.light.4.multim50
ttgggtttgggggggagcctagctgtgctgtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgccaaaacgatttgctttttggtaccaacagaagccaggccaggcccctataataattatatataaagacagtgagaggccctcagggatccctgagcgattctctggctccagctcagggacaacagccacgttgacgattagtggagtccaggcagaagacgaggctgactattactgtcaatcagcagacgacagtggtacttatggagtattcggcggagggaccaaggtgaccgtcctaggtcagcccaagg

SEQ ID NO: 789033 - DNA, 453 bp, Homo sapiens
  misc_feature: NA.43.30.C08.1.454.light.4.multim50
aagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggccgacgggaccgacggtcggagtgtcaagacgaactgtggctgcacctat

SEQ ID NO: 789034 - DNA, 471 bp, Homo sapiens
  misc_feature: NA.43.30.C08.3.454.light.4.multim50
aagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgctaatttattactgtcaccagtatggtagcttcacctctaactttcggcggtagggaccgaaggtaggagatacaaacgaactagtggactgcaccatctgtcttcatcytccccg

SEQ ID NO: 789035 - DNA, 472 bp, Homo sapiens
  misc_feature: NA.52.33.C11.1.454.light.4.multim50
ttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggaccacgrttgagakattaaacgaactgtggctgcaccatctgtcttcatcttccccgccta

SEQ ID NO: 789036 - DNA, 459 bp, Homo sapiens
  misc_feature: NA.52.33.C11.2.454.light.4.multim50
ttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctcgccccctcggtctacg

SEQ ID NO: 789037 - DNA, 463 bp, Homo sapiens
  misc_feature: NA.52.33.C11.4.454.light.4.multim50
ttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactcgtcactcttccg

SEQ ID NO: 789038 - DNA, 442 bp, Homo sapiens
  misc_feature: NA.51.41.D08.1.454.light.4.multim50
caggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggagggaccaaggtggagatcaaacgaactgtggctgcacctatctgtctt

SEQ ID NO: 789039 - DNA, 444 bp, Homo sapiens
  misc_feature: NA.51.41.D08.3.454.light.4.multim50
tgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggatgttggggtttattactgcgtgcaaagtctgcaaactatcaccttcggccaagggacgacgactcggagattaaacgaactagtggctgcacc

SEQ ID NO: 789040 - DNA, 469 bp, Homo sapiens
  misc_feature: NA.51.41.D08.4.454.light.4.multim50
ctgtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaaagatatgcttattggtaccatcagaagtcaggccaggcccctgtactggtcatctatgaggacaccaaacgaccctccgggatccctacgagattctctggctccagtttagggacagtggccaccctgacaatcagtggggcccaggtgggggatgagggtgattactactgttactcaacagacattactactactcatagggtgttcggcggagggaccgaagctgaccgtcctaggtcagcccaacggctcgccccctcggtccactcctgtttcccrccctt

SEQ ID NO: 789041 - DNA, 456 bp, Homo sapiens
  misc_feature: NA.51.41.D08.5.454.light.4.multim50
ctgatcaggactcctcagttcaccytctcacaatgaggctccctgctcagctcctggggctgctaatgctctgggtcccagsatscagtggrgmtgttgtgmtgactcagtctccactctccctgyccgtcacccttggacagccrgcytccatctcctgcaggtctagtcaargcctcgtttatagtgwtggaracacctacttgarttggtttcaycagaggccrggccaatctccaaggcgcctratttataaggtttctaaccgggactctggggtcccagacarattcagcggcagtgggtcaggcactsatttcacactgarratcagcagggtggaggctgaggatgttgggrtttaytactgyatgcaaggtacacactggcctcctatcacyttcggcsragggaccamgastggagrtkaaacgaactgtggctgcaccatctgtt

SEQ ID NO: 789042 - DNA, 470 bp, Homo sapiens
  misc_feature: NA.51.41.D08.6.454.light.4.multim50
aggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccaaggtggaaatgaaaggaactgtggctgcaccatctgtcttcatcttcccgccatctgatcgtagcact

SEQ ID NO: 789043 - DNA, 416 bp, Homo sapiens
  misc_feature: NA.41.57.F02.2.454.light.4.multim50
ttgggtttggggtccaaacagagcttcagcaagcatagtgggaatctgcaccatgccctgggctctgctcctcctgaccctcctcactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcagcccaaggctgccccctcggtcactctgttcccgccctcctcatagtataga

SEQ ID NO: 789044 - DNA, 465 bp, Homo sapiens
  misc_feature: NA.41.57.F02.3.454.light.4.multim50
ttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatrcagatactaagtccttgggtgttcggcgggaggaccaagctgaccgtcctaggtcagcccaaggctgccccctcggta

SEQ ID NO: 789045 - DNA, 502 bp, Homo sapiens
  misc_feature: NA.48.9.A09.1.454.light.4.multim50
agggcacgaccggtgctcgatttagtacasatacgywrgggaaagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 789046 - DNA, 485 bp, Homo sapiens
  misc_feature: NA.48.9.A09.2.454.light.4.multim50
agggcacgaccggtgctcgatttagacgcgagggggaggggagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggaccgagggtaggaaatacaaacgaaacctagtggctgcaccatctgtcttctat

SEQ ID NO: 789047 - DNA, 500 bp, Homo sapiens
  misc_feature: NA.48.9.A09.4.454.light.4.multim50
aggacacgaccggtgctcgatttagatagctctcgtwgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggttttattactgtcagcagcgtgccaactggcctctcacgttcggcggagggaccaaggtggacatcaaacgtaactgtggctgcaccatctgtcttcatcttccccg

SEQ ID NO: 789048 - DNA, 401 bp, Homo sapiens
  misc_feature: NA.48.9.A09.6.454.light.4.multim50
agggtcctgggcccagtctgtggtgactcagccaccctcagcgtctgggacccccggacagagagtcaccatctcctgttctggaagcagcgccaacattggacgtaatactgtcaactggtaccaacaactcgcaggaacggcccccaaactcctcatctatgaccatcataagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcagcccaaggctgccccctcggtcactctcgttcccaccctcctctatgtatact

SEQ ID NO: 789049 - DNA, 444 bp, Homo sapiens
  misc_feature: NA.48.9.A09.7.454.light.4.multim50
aggggagtcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctgaagatgttgcaacttattactgtcaacagcttagtagtaaccctccgtacacttttggccaggggaccaaggtggagatacaaacgaactgtggctgcaccatctgtt

SEQ ID NO: 789050 - DNA, 466 bp, Homo sapiens
  misc_feature: NA.48.9.A09.8.454.light.4.multim50
agggcacgaccggtgctcgatttagtgtcgtcgcaagagagagggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaa

SEQ ID NO: 789051 - DNA, 456 bp, Homo sapiens
  misc_feature: NA.49.27.C05.1.454.light.4.multim50
agggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgttt

SEQ ID NO: 789052 - DNA, 454 bp, Homo sapiens
  misc_feature: NA.49.27.C05.2.454.light.4.multim50
agggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttattactgtcagcagtataatgtmcgggctccggacactttcggcsgagggaccaaggtggagatcaaacgaactgtggctgcaccatctgttt

SEQ ID NO: 789053 - DNA, 476 bp, Homo sapiens
  misc_feature: NA.49.27.C05.5.454.light.4.multim50
agggtttgggggtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggcccctcagggatccctgagcgattctctgggtcccactcaggggccacagccgtgttgaccatcactggagtccaggcagaagacgaggctgactattattgtcagtcagccgacaacactattgtctccgtgtttttcggtcggtagggaccaggctgaccgtcctgggtcacgcccaaggctcgccccctccggtccactctcgttcccccg

SEQ ID NO: 789054 - DNA, 477 bp, Homo sapiens
  misc_feature: NA.49.27.C05.6.454.light.4.multim50
agggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgaggggtgattactactgttactcaacagacattactactactcatagggtgttcgggcggagggaccaagctgaccgtcctaggtcagcccaaggctgccccctcggtcactctgttccccmcctcctcc

SEQ ID NO: 789055 - DNA, 431 bp, Homo sapiens
  misc_feature: NA.49.27.C05.7.454.light.4.multim50
agggtttgggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgctaacttattattgtcaacagagttacagtaatcccgtacacttttggccgaggggaccaggctggataatcagacgaa

SEQ ID NO: 789056 - DNA, 469 bp, Homo sapiens
  misc_feature: NA.51.57.F02.1.454.light.4.multim50
ttgggtttgggtttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactcc

SEQ ID NO: 789057 - DNA, 480 bp, Homo sapiens
  misc_feature: NA.51.57.F02.2.454.light.4.multim50
ttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcactctcgttcccccg

SEQ ID NO: 789058 - DNA, 461 bp, Homo sapiens; identical to SEQ ID NO: 788904
  misc_feature: NA.51.57.F02.4.454.light.4.multim50

SEQ ID NO: 789059 - DNA, 491 bp, Homo sapiens
  misc_feature: NA.51.57.F02.5.454.light.4.multim50
ttgggtttgggcacgaccggtgctttagctcgatatagttgggtttggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtgtcgtggtaccagcagttcccaggaacggcccccagactcctcattcatgacaatcacaagcgagtcccagagattcctgaccgattctctggctccaagtctggcacctcagccaccctggccatcaccggactccagactggggacgaggccgattattactgcggaacatgggattccagcctgagtggtgtcagggtgttcggcggagggaccaagctgaccgtccg

SEQ ID NO: 789060 - DNA, 454 bp, Homo sapiens
  misc_feature: NA.51.57.F02.6.454.light.4.multim50
ttgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtggttcggcgggggaccaagctgaccgtcctcggtcagcccaaggctcgccccctcggtcta

SEQ ID NO: 789061 - DNA, 453 bp, Homo sapiens
  misc_feature: NA.51.57.F02.7.454.light.4.multim50
ttgggtttgggkkwggagtsagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaaccagggacagcccctaaactcctgatcctcgatgcatccactttggaaacaggggtcccatcaaggttcagtggaagtggctctgggacagtattttactttcaccatcagcaggctgcagcctgaagacattgcaacataattacttgtcaacagtatgatagtctcccgcctcacgtttcggacggggggaccgaaggtggaggatcgargcgaamygtggcgtgca

SEQ ID NO: 789062 - DNA, 463 bp, Homo sapiens
  misc_feature: NA.48.55.E11.2.454.light.4.multim50
ttgggtttggggggagaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgcaccatactgtcttt

SEQ ID NO: 789063 - DNA, 467 bp, Homo sapiens
  misc_feature: NA.48.55.E11.3.454.light.4.multim50
ttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcgccccctcsgt

SEQ ID NO: 789064 - DNA, 464 bp, Homo sapiens
  misc_feature: NA.48.55.E11.4.454.light.4.multim50
ttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagacgcccgaagattttgcggtttattactgtcagcagcgtgccaactggcctctcacgttcggcggagggaccaaggtggacatcaaacgaactgtggctgcaccatctgtcttcatcttccccg

SEQ ID NO: 789065 - DNA, 471 bp, Homo sapiens
  misc_feature: NA.48.55.E11.5.454.light.4.multim50
ttgggtttggggtggggagcttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccccg

SEQ ID NO: 789066 - DNA, 468 bp, Homo sapiens
  misc_feature: NA.48.55.E11.7.454.light.4.multim50
ttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagtattttactattttattactgtcagcagtatcgtaagtggactccgacgtttggccaagggaccaaggtggaagtcaaacgaactgtggctgcaccatctgttcttcatccttcccgcc

SEQ ID NO: 789067 - DNA, 450 bp, Homo sapiens
  misc_feature: NA.48.55.E11.10.454.light.4.multim50
ttgggtttggagckgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcacgymcgaccgaacggacc

SEQ ID NO: 789068 - DNA, 495 bp, Homo sapiens
  misc_feature: NA.48.55.E11.11.454.light.4.multim50
ttgggtttggggagcttsrgytkkggkagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcaggcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagcccaaggctgccccctcggtcactctgttcccgccctcctcta

SEQ ID NO: 789069 - DNA, 452 bp, Homo sapiens
  misc_feature: NA.48.87.H10.1.454.light.4.multim50
ttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccctcg

SEQ ID NO: 789070 - DNA, 462 bp, Homo sapiens
  misc_feature: NA.48.87.H10.2.454.light.4.multim50
ttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctccgcctc

SEQ ID NO: 789071 - DNA, 473 bp, Homo sapiens
  misc_feature: NA.48.87.H10.3.454.light.4.multim50
ttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccgaaggtggaggtcgaaacgaactagtggctgcaccatctgtcttcta

SEQ ID NO: 789072 - DNA, 467 bp, Homo sapiens
  misc_feature: NA.48.87.H10.5.454.light.4.multim50
ttgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctcgttccccg

SEQ ID NO: 789073 - DNA, 474 bp, Homo sapiens
  misc_feature: NA.48.87.H10.6.454.light.4.multim50
ttgggtttgggttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 789074 - DNA, 453 bp, Homo sapiens
  misc_feature: NA.48.87.H10.7.454.light.4.multim50
ttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgacggacgaggctgattactactgtcagtcttatgatagtggcaattaagtgtttgggtgtttggcggagggaccaagctgaccgtcctaggtcacg

SEQ ID NO: 789075 - DNA, 449 bp, Homo sapiens
  misc_feature: NA.48.87.H10.8.454.light.4.multim50
ttgggtttgggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcaggtgggtctgggacagacttcactctcaccatcagcagactggagcctgaagattttgcagtgtattactgtcagcagtatggtagctcacctcaactcactttcggcggagggaccgaaggtggagatcaaacgaactgtggctgca

SEQ ID NO: 789076 - DNA, 509 bp, Homo sapiens
  misc_feature: NA.17.31.C09.1.454.light.4.multim50
agataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcctagtctacgtcg

SEQ ID NO: 789077 - DNA, 397 bp, Homo sapiens
  misc_feature: NA.52.72.G06.3.454.light.4.multim50
ctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtcactctgttcccaccctcctctatacgatcg

SEQ ID NO: 789078 - DNA, 445 bp, Homo sapiens
  misc_feature: NA.52.72.G06.4.454.light.4.multim50
tgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactcgtcacty

SEQ ID NO: 789079 - DNA, 465 bp, Homo sapiens
  misc_feature: NA.40.55.E11.2.454.light.4.multim50
tttgggtttgggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtcctaggtcagcccaaggctgccccctccg

SEQ ID NO: 789080 - DNA, 465 bp, Homo sapiens
  misc_feature: NA.40.55.E11.4.454.light.4.multim50
ttgggtttgggggagtcagacccactcaggacacagcatggacatgagggtccccgctcagctcctggggctcctgctgctctggctcccaggtgccagatgtgccatccagatgacccagtctccatcctccctgtctgtatctgtaggagacaaagtcaccatcacttgccgggcaagtcaggacattagaaatgaattagcctggtttcagcagaaaccagggaaagcccctaagctcctgatctatgctgcatccactttagaaaatggggtcccatcaagattcagcggcagtggatctggcacagatttcactctcaccgtcagcagcctgcagtctgaagattttgctaacttattacttgtctacaagtattataattaccctcggacgttcggccgtmcrgggaccgaacggtaggtamgtgtckaagacggaacgtacgtggcgtgcgaccaayt

SEQ ID NO: 789081 - DNA, 461 bp, Homo sapiens
  misc_feature: NA.48.80.H03.1.454.light.4.multim50
aagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtacttttagtttacgtcggaccttcggccaagggacacgactggagattaaacgaactgtggctgcaccatctgtcttcatcttccccg

SEQ ID NO: 789082 - DNA, 470 bp, Homo sapiens
  misc_feature: NA.48.80.H03.4.454.light.4.multim50
aagggaaaggggggggaggaactgctcagttaggacccagacggaaccatggaagccccagcgcagcttctcttcctcctgctactctggctcccagatgtcactggagaaaaataatgacgcagtctccagcccccctgcctgtgtctccaggggaaagagccaccctctcctgcagggccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagattttgctattttattactgtcagcactataataactggccacgtggacgttcggccgaagggaccgaaggwaskrwrkmyrmacsawctgtkgctgca

SEQ ID NO: 789083 - DNA, 472 bp, Homo sapiens
  misc_feature: NA.48.80.H03.5.454.light.4.multim50
aagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattaattatactccgccgacgttcggtccggggaccgaacgtcggaaatacaaaacgaactagtggctgcaccactctcg

SEQ ID NO: 789084 - DNA, 471 bp, Homo sapiens
  misc_feature: NA.48.80.H03.7.454.light.4.multim50
cggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattggggggagaaattatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggtaccgaggctgaccgtcggcggtcgagcccaaggctsscccctcggtcactctcgttcccrccctccctct

SEQ ID NO: 789085 - DNA, 484 bp, Homo sapiens
  misc_feature: NA.41.37.D04.1.454.light.4.multim50
ttgggtttgggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgtccccccggtccactctcgttccccg

SEQ ID NO: 789086 - DNA, 445 bp, Homo sapiens
  misc_feature: NA.41.37.D04.4.454.light.4.multim50
ttgggtttgggggaggaactgctcagttaggacccagacggaaccatggaagccccagcgcagcttctcttcctcctgctactctggctcccagataccactggagaaatagtgatgacgcagtctccagacaccctgtctgtgtctccaggggaaagagccaccctctcctgcagggccagtcagagtgtcaccaacaagttggcctggtaccagcagaaatctggtcagtctcccaggctcctcatttacagtgcagacaccagggccactggtgtcccagacaggttcagtggcagtgggtctgggacagagttcactctcagcctcagcagccttcagtctgaagattttgcagtgtattactgtcagcaatatcataagtggcctctcactttcggcggagggaccaaggtggagatcaaacgaactgtggctgcaccat

SEQ ID NO: 789087 - DNA, 460 bp, Homo sapiens
  misc_feature: NA.13.71.G05.1.454.light.4.multim50
cctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataccaagcggccctcagggatccctgagcgattctctggctccaactctgggaacacagccactctgaccatcagcgggacccaggctgtggatgaggctgactattactgtcaggcgtgggacagcagcactgcctccttcggaactgggaccaaggtcaccgtcctaggtcagcccaaggccaaccccactcgtcactctcgttccccvccctccttacg

SEQ ID NO: 789088 - DNA, 448 bp, Homo sapiens
  misc_feature: NA.41.37.D04.6.454.light.4.multim50
ttgggtttgggggatcaggacttctcagttcatcttctcaccatgaggctccctgctcagctcctggggctgctaatgctctggatacctggatccagtgcagatattgtgatgtcccagactccactctctctgtccgtcacccctggacagccggcctccatctcctgcaagtctagtcagagtctcctccatgagaatggcaaaacttatttctactggtacctacagaaggcaggccagccgccacagctcctgatctatgaggttttcaggcggttctctggagtgccagacaggttcagtggcagcgggtccgggacagatttcacactgaggatcagtcgggtggaggctgacgacgttgggacttattactgcgcgcaaagtctacaccttcctctcactttgggccctgggaccaaagtggacatcaaacgaactgtgg

SEQ ID NO: 789089 - DNA, 483 bp, Homo sapiens
  misc_feature: NA.41.37.D04.7.454.light.4.multim50
ttgggtttgggggaggaactgctcagttaggacccagacggaaccatggaagccccagcgcagcttctcttcctcctgctactctggctcccagataccactggagaaatagtgatgacgcagtctccagacaccctgtctttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 789090 - DNA, 480 bp, Homo sapiens
  misc_feature: NA.41.37.D04.8.454.light.4.multim50
ttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctcgccccctcggtcactctcgttccccg

SEQ ID NO: 789091 - DNA, 420 bp, Homo sapiens
  misc_feature: NA.41.12.B01.1.454.light.4.multim50
tccgcgggcacgaccggtgctcgatttagtagtgtagattccgcgggcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 789092 - DNA, 441 bp, Homo sapiens
  misc_feature: NA.41.12.B01.2.454.light.4.multim50
tccgcgggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattacttgccgggcaagtcagggcattagaaatgatttagcctggtatcggcagaaaccaggaaaagcccctcagctcctcatctgtactgcatccactttacaaagtggggtcccatcaaggttcagcggcagtggatctggcacagatttcactctcaccatcagcagcctgcagcctgaagattttgcaacttattactgtctacaagattacaattaccctcggacttttggccaggggaccaggctggagatcaaacgaactagtggctgcaccta

SEQ ID NO: 789093 - DNA, 478 bp, Homo sapiens
  misc_feature: NA.41.12.B01.5.454.light.4.multim50
tccgcgggcacgaccggtgctcgatttagcagcactabhgttgggtttgggggctggggtctcaggaggcagcgctctcgggacgtctccaccatggcctgggctctgctvctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtayktggcggagggaccaagctgaccg

SEQ ID NO: 789094 - DNA, 484 bp, Homo sapiens
  misc_feature: NA.41.12.B01.7.454.light.4.multim50
tccgcgggcacgaccggtgctcgatttagcagtactgcgttgggtttgggggctggggtctcaggaggcagcgctctcaggacgtcaccaccatggcctgggctctgctcctcctcaycctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaaacaatttcagggttatttggcggagggaccaaggctacgkacccg

SEQ ID NO: 789095 - DNA, 479 bp, Homo sapiens
  misc_feature: NA.41.12.B01.8.454.light.4.multim50
tccgcgggcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcacg

SEQ ID NO: 789096 - DNA, 456 bp, Homo sapiens
  misc_feature: NA.3.12.B01.1.454.light.4.multim50
tccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgctagtttattactgtcagcattacaataactggcctcggctcactttcggcggagggaccaaggtggagatcaaacgaactgtggctgcaccatctgtcttcta

SEQ ID NO: 789097 - DNA, 460 bp, Homo sapiens
  misc_feature: NA.48.35.D02.2.454.light.4.multim50
ttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgccccccg

SEQ ID NO: 789098 - DNA, 467 bp, Homo sapiens
  misc_feature: NA.48.35.D02.4.454.light.4.multim50
tttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcgccccctcgg

SEQ ID NO: 789099 - DNA, 469 bp, Homo sapiens
  misc_feature: NA.48.35.D02.5.454.light.4.multim50
ttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcagccctgcaggctgaggatgtggctagttttattactgttcagcaatattatactactccgtggactttcggccaagggaccgaaggtaggaaatacagacgaactagtggctcgcaccta

SEQ ID NO: 789100 - DNA, 463 bp, Homo sapiens; identical to SEQ ID NO: 788729
  misc_feature: NA.48.35.D02.6.454.light.4.multim50

SEQ ID NO: 789101 - DNA, 451 bp, Homo sapiens
  misc_feature: NA.48.35.D02.8.454.light.4.multim50
ttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgttttggcggagggaccaagctgaccgtcctaggtcacg

SEQ ID NO: 789102 - DNA, 438 bp, Homo sapiens
  misc_feature: NA.16.86.H09.2.454.light.4.multim50
tttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctcctcgagtagtaca

SEQ ID NO: 789103 - DNA, 462 bp, Homo sapiens
  misc_feature: NA.52.27.C05.1.454.light.4.multim50
agggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtctttcggaactgcgaccaaggtcaccgtcctgggtcagcccaaggccaaccccactgtcactctycg

SEQ ID NO: 789104 - DNA, 458 bp, Homo sapiens
  misc_feature: NA.52.27.C05.3.454.light.4.multim50
agggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtctaggtcagcccaaggctgccccctcggtcactcg

SEQ ID NO: 789105 - DNA, 447 bp, Homo sapiens
  misc_feature: NA.52.27.C05.5.454.light.4.multim50
agggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgctaacttattactgtcaacaccttaatagttactccttcactttcggccctggaccaagtggacatcaaacgaactgtggctgcaccatctgttt

SEQ ID NO: 789106 - DNA, 450 bp, Homo sapiens
  misc_feature: NA.52.27.C05.6.454.light.4.multim50
agggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcgaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctgccccccg

SEQ ID NO: 789107 - DNA, 484 bp, Homo sapiens
  misc_feature: NA.43.27.C05.2.454.light.4.multim50
agggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccaacggacccgaaacccccaacccgtta

SEQ ID NO: 789108 - DNA, 469 bp, Homo sapiens
  misc_feature: NA.43.27.C05.3.454.light.4.multim50
agggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcatttattactgcagctcatatacaggcaacaagaatttggtgttcggcggagggaccgagctgaccgtcctaggtcagcccaaggctsscccctcggtctacg

SEQ ID NO: 789109 - DNA, 461 bp, Homo sapiens
  misc_feature: NA.43.27.C05.4.454.light.4.multim50
agggtttggggctccaaacagagcttcagcaaggatagtgggattctgcaccatgcccagggctctgctcctcctgaccctcctcactcactctgcagtgtcagtggtccaggcaggactgactcagccaccctcggtgtccaagtaattgagacacaccgccacactcacctgcgctgggaacaacagtagtgtcgacaatcaaggagcagcttggctgctgcagttcaagagtcagggataacaaaccggccctcagggatctcatagagactatctgcatccaggtcaggaaagacagcctccctgaccattactggactccggcctgaggacgagtctgaccattactgctcaccttggggcagtagtgtcaatactcggggtgttcggcggagggaccaaccggaccgtcctaggtcagcccaaggctgccccctcggtcactctgttcccaccct

SEQ ID NO: 789110 - DNA, 462 bp, Homo sapiens
  misc_feature: NA.49.58.F03.1.454.light.4.multim50
aagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaacccactgtcactctcg

SEQ ID NO: 789111 - DNA, 455 bp, Homo sapiens
  misc_feature: NA.49.58.F03.2.454.light.4.multim50
aagggaaagggggatcaggactcctcagttcacctcctcacaatgaggctccctgctcagctcctggggctgctaatgctctgggtctctggatccagtgggggtattgtgatgactcagtctccactctccctgcccgtcacccctggagagtcggcctccatctcctgcaggtctagtcagagcctcctatatagggatggatacaactatttggattggtacgtgcagaagccagggaagcctccacagctcctgatctatctggcttctaatcgggcctccggggtccctgacaggttcagcggcagtgtgtccggcacagattttacactaaaaatcagcagagtggaggctgacgatattggggtttattactgcatgcaagcaatacaccgcctcactttcggcggagggaccacactggagatcaaacgaactagtggctgcaccta

SEQ ID NO: 789112 - DNA, 456 bp, Homo sapiens
  misc_feature: NA.49.58.F03.4.454.light.4.multim50
aagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtcttctac

SEQ ID NO: 789113 - DNA, 506 bp, Homo sapiens
  misc_feature: NA.49.58.F03.5.454.light.4.multim50
aagggaaaggggctggggagmmkrgmwrkgskgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctcgccccctcggtcactyygttcccgccctcctctctctcgact

SEQ ID NO: 789114 - DNA, 455 bp, Homo sapiens
  misc_feature: NA.49.58.F03.6.454.light.4.multim50
aagggaaaggggactgatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctrcagaagccagggcaggctccacagctcctgatctatttgggttcgaatcgggcctccggggtccctgacaggttcagtggcagtggatcaggcacagtattttacactagaaaatcagcagagtggaggctgaggatggttgggattttattactgtcatgcaagctctacaagctcctcagctcactttcggcggaagggaccgaaggtggaagatcaaaacg

SEQ ID NO: 789115 - DNA, 508 bp, Homo sapiens
  misc_feature: NA.40.57.F02.1.454.light.4.multim50
ttgggtttgggcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaaggctccgkccccccg

SEQ ID NO: 789116 - DNA, 471 bp, Homo sapiens
  misc_feature: NA.43.55.E11.3.454.light.4.multim50
tttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaactttcggtcaggggaccaagttgaacatcaatcgaactgtggctgcaccatctgtcttcattcttcccgccta

SEQ ID NO: 789117 - DNA, 477 bp, Homo sapiens
  misc_feature: NA.43.55.E11.4.454.light.4.multim50
ttgggtttggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgaccgtcctasgtcagcccaaggcctcgccccctcggtcactctcgtt

SEQ ID NO: 789118 - DNA, 488 bp, Homo sapiens
  misc_feature: NA.48.23.C01.1.454.light.4.multim50
tagggattggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggaccaagttgaccgtcctaggtcaacccaaggctcgccccctcggtccactctgttcccka

SEQ ID NO: 789119 - DNA, 463 bp, Homo sapiens
  misc_feature: NA.48.23.C01.2.454.light.4.multim50
tagggattgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctccg

SEQ ID NO: 789120 - DNA, 484 bp, Homo sapiens
  misc_feature: NA.48.23.C01.3.454.light.4.multim50
tagggattggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcattcccgccatctgatatgtatact

SEQ ID NO: 789121 - DNA, 442 bp, Homo sapiens
  misc_feature: NA.48.23.C01.5.454.light.4.multim50
tagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggttgggttttcggcgggagggaccgaagctgaccgtcctaagtcagcccaac

SEQ ID NO: 789122 - DNA, 495 bp, Homo sapiens
  misc_feature: NA.48.23.C01.6.454.light.4.multim50
tagggattggggagctagggattggggagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagcccaaggctgccccctcggtcyactctgttcccascctcctcta

SEQ ID NO: 789123 - DNA, 466 bp, Homo sapiens
  misc_feature: NA.48.23.C01.7.454.light.4.multim50
tagggattgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggacggagggaccaagctgaccgtcctaggtcacgcccaaggctcgccccctc

SEQ ID NO: 789124 - DNA, 443 bp, Homo sapiens
  misc_feature: NA.49.72.G06.2.454.light.4.multim50
atcaggactcctcagttcacctcctcacaatgaggctccctgctcagctcctggggctgctaatgctctgggtctctggatccagtgggggtattgtgatgactcagtctccactctccctgcccgtcacccctggagagtcggcctccatctcctgcaggtctagtcagagcctcctatatagggatggatacaactatttggattggtacgtgcagaagccagggaagcctccacagctcctgatctatctggcttctaatcgggcctccggggtccctgacaggttcagcggcagtgtgtccggcacagattttacactaaaaatcagcagagtggaggctgacgatattggggtttattactgcatgcaagcaatacaccgcctcactttcggcggagggaccacactggagatcaaacgaactagtggctgcaccata

SEQ ID NO: 789125 - DNA, 446 bp, Homo sapiens
  misc_feature: NA.49.72.G06.4.454.light.4.multim50
tgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaacccactgtcactctcg

SEQ ID NO: 789126 - DNA, 451 bp, Homo sapiens
  misc_feature: NA.49.72.G06.6.454.light.4.multim50
ctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggctttgatgtccactggtaccagcagcttccaggaacagcccccaaactcctcatctatggtaacaacaatcggccctcaggggtccctgaccgattctctgcctccaagtctgccacctcggcctccctggccatcactgggctccaggctgaagatgaggctgattattactgccagtcctatgacagcaccatgagtcgttccgtggtcttcggcggagggacccagctgaccgtctaggtcagcccaa

SEQ ID NO: 789127 - DNA, 398 bp, Homo sapiens
  misc_feature: NA.49.72.G06.7.454.light.4.multim50
atcaggactcctcagttcacctcctcacaatgaggctccctgctcagctcctggggctgctaatgctctgggtctctggatccagtgggggtattgtgatgactcagtctccactctccctgcccgtcacccctggagagtcggcctccatctcctgcaggtctagtcagagcctcctatatagggatggatacaactatttggattggttcagcggcagtgtgtccggcacagattttacactaaaaatcagcagagtggaggctgacgatattggggtttattactgcatgcaagcaatacaccgcctcactttcggcggagggaccacactggagatcaaacgaactgtggctgcaccatctgtcttcatcttcccgccatctgatctctcgact

SEQ ID NO: 789128 - DNA, 454 bp, Homo sapiens
  misc_feature: NA.41.17.B06.1.454.light.4.multim50
agggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttactctcaccatcaacggcctgcagtctgaagattctgcagtttattactgtcagcagtatgttgactggcctccgctcactttcggcggagggaccaaggtggagatcagacgaactgtggctgcacccattctgtcttcatt

SEQ ID NO: 789129 - DNA, 513 bp, Homo sapiens
  misc_feature: NA.51.37.D04.3.454.light.4.multim50
ttgggtttgggcacgaccggtgctcgattkrgtwksrkrskgttgggtttggggtgtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgccaaaacgatttgctttttggtaccaacagaagccaggccaggcccctataataattatatataaagacagtgagaggccctcagggatccctgagcgattctctggctccagctcagggacaacagccacgttgacgattagtggagtccaggcagaagacgaggctgactattactgtcaatcagcagacgacagtggtacttatggagtattcggcggagggaccaaggtgaccgtcctaggtcagcccaaggctgccccctcggtcactctcgttcccccg

SEQ ID NO: 789130 - DNA, 477 bp, Homo sapiens
  misc_feature: NA.51.37.D04.4.454.light.4.multim50
ttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtaggaaatacaaacgaactagtggctgcaccatctgtcttctattcc

SEQ ID NO: 789131 - DNA, 461 bp, Homo sapiens
  misc_feature: NA.51.37.D04.5.454.light.4.multim50
ttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactcgtcacttccg

SEQ ID NO: 789132 - DNA, 481 bp, Homo sapiens
  misc_feature: NA.51.37.D04.6.454.light.4.multim50
ttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtacccctcagctcactttcggcggagggaccaaggtggagatcaaacgaactgtggctgcaccatctgtcttcatcttcccgccatctgatcgtagcact

SEQ ID NO: 789133 - DNA, 462 bp, Homo sapiens
  misc_feature: NA.51.37.D04.7.454.light.4.multim50
ttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccgagtctgaccgtcctaggtcagcccaaggctcgccccctcggtcactcktccg

SEQ ID NO: 789134 - DNA, 466 bp, Homo sapiens
  misc_feature: NA.43.24.C02.2.454.light.4.multim50
tagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggttattataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattattgcagttcatatacaagcagcaccactattatgtcttcggagctgggaccaaggtcaccgtcctaggtcagcccaaggcccaaccccactgt

SEQ ID NO: 789135 - DNA, 367 bp, Homo sapiens
  misc_feature: NA.43.24.C02.3.454.light.4.multim50
tagggaaaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggttcagtggcagtggatcaggcacagattttacactgaaaatcagcagagtggaggctgaggatgttggggtttattactrcatgcaagctctacaaactccgctcactttcggcggagggaccaaggtggagatcaaacgaactgtggctgcaccatctgtcttcatcttcccgccatctgaactactcaca

SEQ ID NO: 789136 - DNA, 445 bp, Homo sapiens
  misc_feature: NA.41.34.D01.1.454.light.4.multim50
ttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcacctacg

SEQ ID NO: 789137 - DNA, 470 bp, Homo sapiens
  misc_feature: NA.49.23.C01.2.454.light.4.multim50
tagggattgggaggctggtcatagggattgggggagtcagacccagtcaggacacagcatggacatgagggtccccgctcagctcctggggctcctgctgctctggctcccaggtgccaaatgtgacatccagatgacccagtctccttccaccctgtctgcatttgtaggagacagagtcaccatcacttgccgggccagtcagagtattagtagccggttggcctggcatcagcagaaacccgggaaagcccctaagctcctgatatatgaggcgtccagtttagaaagtggggtcccatcaaggttcagcggcagtggatctgggacagagttcactctcaccatcagcagcctgcagcctgatgattttgcaacttattactgccaacagtataatagttattcgtatacttttggcctaggggaccaagctggagatcaaacgaactgtggctgcaccatctgtt

SEQ ID NO: 789138 - DNA, 445 bp, Homo sapiens
  misc_feature: NA.49.53.E09.1.454.light.4.multim50
ttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggaccgaaggtggagatcaagacgaactgtggctgcaccta

SEQ ID NO: 789139 - DNA, 449 bp, Homo sapiens; identical to SEQ ID NO: 788963
  misc_feature: NA.49.53.E09.2.454.light.4.multim50

SEQ ID NO: 789140 - DNA, 469 bp, Homo sapiens
  misc_feature: NA.49.53.E09.6.454.light.4.multim50
ttgggtttgggggtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactatgtctccgtgttttcggtcggagggaccaggctgaccgtcctgggtcagcccaaggctcgccccctcggtcactctcgttcccgt

SEQ ID NO: 789141 - DNA, 387 bp, Homo sapiens
  misc_feature: NA.49.53.E09.7.454.light.4.multim50
ttgggtttgggtgacatccagatgacccagtctyyrksytysskgtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 789142 - DNA, 452 bp, Homo sapiens
  misc_feature: NA.48.73.G07.1.454.light.4.multim50
agggcacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcggggggaccaggctgaccgtc

SEQ ID NO: 789143 - DNA, 502 bp, Homo sapiens
  misc_feature: NA.48.73.G07.2.454.light.4.multim50
agggcacgaccggtgctcgatttagagctcacgtattgggttagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccgt

SEQ ID NO: 789144 - DNA, 502 bp, Homo sapiens
  misc_feature: NA.48.73.G07.3.454.light.4.multim50
agggcgaccggtgctcgatttagcgagacgcgcagggcacgaccggtgctcgatttagcagcacactagttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgtaacg

SEQ ID NO: 789145 - DNA, 507 bp, Homo sapiens
  misc_feature: NA.48.73.G07.6.454.light.4.multim50
agggcacgaccggtgctcgatttagctctacgctcagggcacgaccggtgctcgatttagtgagtcagtaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtccggtaccttcggccaagggacaccgacgtcggagaattaaacgaacygtgtc

SEQ ID NO: 789146 - DNA, 478 bp, Homo sapiens
  misc_feature: NA.48.73.G07.8.454.light.4.multim50
agggcacgaccggtgctcgatttagtgtgagtagttccgcggggactgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgtacgtttttaaacgggagtctggggtcccagacagattcagcggcagtgggtcagacactgacttcacactgagaatcagcagggttgaggctgaggatggttggcacgttattactgcatgcaaggctcacactggctccgtggacgttcggccagggaccgggtaggaatamracg

SEQ ID NO: 789147 - DNA, 471 bp, Homo sapiens
  misc_feature: NA.48.73.G07.9.454.light.4.multim50
agggcacgaccggtgctcgatttagakagaststcgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactaatcactggggcccaggtggaggatgaaggtgactacttctgtttctcaacagacaccagtgacaatcatgcgattttcggcggagggaccaagctgaccgtcctgggt

SEQ ID NO: 789148 - DNA, 496 bp, Homo sapiens
  misc_feature: NA.48.73.G07.12.454.light.4.multim50
agggcacgaccggtgctcgatttagtctgatcgakaagggaaagggggaggaactgctcagttaggacccagacggaaccatggaagccccagcgcagcttctcttcctcctgctactctggctcccagatgtcactggagaaaaaataatgacgcagtctccagcccccctgcctgtgtctccaggggaaagagccaccctctcctgcagggccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagattttgctattttattactgttcagcactataataactggccacgtggacgttcggaccragggaccaaggtggaaatcaaacgaactgtgg

SEQ ID NO: 789149 - DNA, 503 bp, Homo sapiens
  misc_feature: NA.48.73.G07.13.454.light.4.multim50
agggcacgaccggtgctcgatttagctctacgctcagggcacgaccggtgctcgatttagagtgctacgaagggaaaggggctgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaacttatttggattggtacctgcagaagccagggcagtctccacagctcctgatctatttgggttctaagtcgggcctccggggtccctgacaggttcaggtggcagtggatcaggcacagtattttacactagaaaatcagcagagtggaggctggaggwwgttggggtttakkrsgttttattactgcagtgcaagctactacaaactccgtcgggcgttacc

SEQ ID NO: 789150 - DNA, 472 bp, Homo sapiens
  misc_feature: NA.49.9.A09.1.454.light.4.multim50
agggcacgaccggtgctcgatttagagtagtgatcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccaaggtggagatacaaacgaactgtggctgcaccta

SEQ ID NO: 789151 - DNA, 488 bp, Homo sapiens
  misc_feature: NA.49.9.A09.2.454.light.4.multim50
aggaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggccaccctgaccgtcagcagggtcgaagccggggatgaggccgactatatctgtcaggtgtgggatagtagtagtgctcgttccgggggtgttcggcggagggaccaagttgaccgtcgttggtcagcccaaggctgccccctcggtcactctgttcccaccctcctctctctcgtact

SEQ ID NO: 789152 - DNA, 478 bp, Homo sapiens
  misc_feature: NA.49.9.A09.3.454.light.4.multim50
aggggctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgccctcctctctctccg

SEQ ID NO: 789153 - DNA, 465 bp, Homo sapiens
  misc_feature: NA.49.15.B04.1.454.light.4.multim50
tccgcgggagtccgcgggggaagagctgctcagttaggacccagagggaaccatggaaaccccagcgcagcttctcttcctcctgctactctggctcccagataccaccggcgaagttgtgttgacgcagtctccaggcaccttgtctctgtctccaggggaaacagccaccctctcctgcagggccagtcagagtgttggcagctattatatagcctggtaccagcagaaacctggccaggctcccaggctcctcatctatggcggatccaacagggccactggcatcccagacaggttcagtggcagtgggtctgggccagacttcactctcacgatcaacagactggagcctgacgatatgggaatgtattactgcgagcagtttgggaactcaccatggacgttcggccgaggggaccaaggtggagatacaaacgaactgtggctgcaccatctgtcttt

SEQ ID NO: 789154 - DNA, 417 bp, Homo sapiens
  misc_feature: NA.49.15.B04.5.454.light.4.multim50
tccgcgggcacgaccggtgctcgatttagcagtatatatccgcgggcacgaccggtgctcgatttagacacatacgcagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgaggtcaccgtcctgggtcagcccaaggccaaccccactgtcactctgttcccgccctcctctctctcgact

SEQ ID NO: 789155 - DNA, 501 bp, Homo sapiens
  misc_feature: NA.49.15.B04.6.454.light.4.multim50
tccgcgggcacgaccggtgctcgatttagacagtatatatccgcgggcacgaccggtgctcgatttagtagtgtagattccgcgggcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccgacggtggagawcaaacgaact

SEQ ID NO: 789156 - DNA, 432 bp, Homo sapiens
  misc_feature: NA.49.15.B04.7.454.light.4.multim50
tccgcgggcacgaccggtgctcgatttagatcgtckrtcgwwgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaata

SEQ ID NO: 789157 - DNA, 460 bp, Homo sapiens
  misc_feature: NA.52.35.D02.2.454.light.4.multim50
ttgggtttgggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttccccg

SEQ ID NO: 789158 - DNA, 478 bp, Homo sapiens
  misc_feature: NA.52.35.D02.1.454.light.4.multim50
ttgggtttggggggggagcttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcc

SEQ ID NO: 789159 - DNA, 449 bp, Homo sapiens
  misc_feature: NA.52.35.D02.3.454.light.4.multim50
ttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaacaccttaatagttactccttcactttcggccctgggaccaaagtggacatcaaacgaactagtggctgcaccatctgtt

SEQ ID NO: 789160 - DNA, 477 bp, Homo sapiens
  misc_feature: NA.52.35.D02.4.454.light.4.multim50
ttgggtttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaatttgggggttttcggcggagggaccaagggtgaccgtcctacgtcagcccaaggctgccccctcggtcactctgtt

SEQ ID NO: 789161 - DNA, 467 bp, Homo sapiens
  misc_feature: NA.49.66.F11.1.454.light.4.multim50
aggggagagccagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttcccgycat

SEQ ID NO: 789162 - DNA, 457 bp, Homo sapiens
  misc_feature: NA.52.35.D02.6.454.light.4.multim50
ttgggtttgggggtgggtccaggaggcagaactctgggtgtctcaccatggcctggatccctctacttctccccctcctcactctctgcacaggctctggggcctcctatgaactgrcacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaaggctgaccgtcctaggtcagcccaaggctgccccctggtcta

SEQ ID NO: 789163 - DNA, 476 bp, Homo sapiens
  misc_feature: NA.51.23.C01.1.454.light.4.multim50
tagggattgggtagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagatcaaacgaactgtggctgcaccatctgtcttcatcttcccgccatct

SEQ ID NO: 789164 - DNA, 459 bp, Homo sapiens
  misc_feature: NA.51.23.C01.2.454.light.4.multim50
tagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcacttccg

SEQ ID NO: 789165 - DNA, 420 bp, Homo sapiens
  misc_feature: NA.51.23.C01.3.454.light.4.multim50
tagggattgggggaggaactgctcagttaggacccagagggaaccatggaagccccagctcagcttctcttcctcctgctactctggctcccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagatcaaacgaactgtggctgcaccatctgtcttcatcttcccgccatctgatcgtagcact

SEQ ID NO: 789166 - DNA, 487 bp, Homo sapiens
  misc_feature: NA.48.58.F03.1.454.light.4.multim50
aagggaaagggggaggttctttctaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtacttttagtttacgtcggaccttcggccaagggacacgactggagattaaacgaactgtggctgcaccatctgtcttcatcttccccgta

SEQ ID NO: 789167 - DNA, 462 bp, Homo sapiens
  misc_feature: NA.48.58.F03.4.454.light.4.multim50
aagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccgaacgtggaaatacaaacgaactagtggctgcaccat

SEQ ID NO: 789168 - DNA, 464 bp, Homo sapiens
  misc_feature: NA.48.58.F03.5.454.light.4.multim50
aagggaaaggggagagctgctcagttaggacccagagggaaccatggaaaccccagcgcagcttctcttcctcctgctactctggctcccagataccgccggagaaattttgttgacgcagtctccaggcaccctgtctttgtctccaggggaaagagccaccctctcctgcagggccagtcagtatgttagcagcaactacttagcctggtaccagcagaaacctggccaggctcccaggctcctcatctacggtgcatccagcagggccattggcatcccagacaggttcagtggcagtgggtctgggacaaacttcactctcaccatcagcagactggagcctgaagattttgcagtctattactgtcagcagtatactaactcacctaagacgttcggccaagggaccaaggtggaaatcaaacgaactgtggctgcaccatctgtcttcatcttccccg

SEQ ID NO: 789169 - DNA, 485 bp, Homo sapiens
  misc_feature: NA.48.58.F03.6.454.light.4.multim50
aagggcttgatravggggggaagcctgagaacacttagccttcatgagtgtccccaccatggcctggatgatgcttctcctcggactccttgcttatggatcaggcgtgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggttttctggctccatcgttgggggcaaagccgccctcaccatcacgggggcccaggcagaggatgaggcgaattattattgtatgctccacaggggcaggggcacctgggagttcggcggcgggaccaagctgaccgtcctaggtcagcccaaggctgccccctcggtcactctgttccccc

SEQ ID NO: 789170 - DNA, 481 bp, Homo sapiens
  misc_feature: NA.48.58.F03.7.454.light.4.multim50
aaggggtgggggtcacaagaggcagcgctctcgggacgtctccaccatggcctgggctctgctgctcctcaccctcctcactcaggacacgagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacaccggcctccctcacaatctctgggctccaggctgacgacgaggcttcctattgctgctcctcatatgtaggatccggcttcttatctgtattttcggcggagggaccaagctcgaccgtcctacgtcagcccaaggctcgccccctcggtcactctcgtycct

SEQ ID NO: 789171 - DNA, 480 bp, Homo sapiens
  misc_feature: NA.48.58.F03.3.454.light.4.multim50
aagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccgaccct

SEQ ID NO: 789172 - DNA, 462 bp, Homo sapiens
  misc_feature: NA.48.29.C07.2.454.light.4.multim50
agggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccgccta

SEQ ID NO: 789173 - DNA, 482 bp, Homo sapiens
  misc_feature: NA.48.29.C07.3.454.light.4.multim50
agggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaaggccggggatgaggccgactattactgtcaggtgtgggatagtagtagtgatcatcctaattgggtgttcggcggagggaccaagctgaccgtcctaggtcagcccaaggctcgccccctcggtcactctcgttcccgccctt

SEQ ID NO: 789174 - DNA, 470 bp, Homo sapiens
  misc_feature: NA.48.29.C07.4.454.light.4.multim50
agggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagaatgttarcagcmactacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctmggtacacttcggccaggggaccaaggtggaaatcaaacgaactgtggctgcaccatctgtcttcatcttcccgccat

SEQ ID NO: 789175 - DNA, 480 bp, Homo sapiens
  misc_feature: NA.3.87.H10.1.454.light.4.multim50
tttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcagcccaaggctgccccctcggtcactccg

SEQ ID NO: 789176 - DNA, 463 bp, Homo sapiens
  misc_feature: NA.48.29.C07.6.454.light.4.multim50
agggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggccaacgggaccgaacggtaggaaagtacaaacgaactagtggcgtgcacca

SEQ ID NO: 789177 - DNA, 465 bp, Homo sapiens
  misc_feature: NA.48.29.C07.8.454.light.4.multim50
agggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccaacgtggaaatacaaacgaactgtggctgcaccatctgtt

SEQ ID NO: 789178 - DNA, 448 bp, Homo sapiens
  misc_feature: NA.48.29.C07.9.454.light.4.multim50
agggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgccccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcaccat

SEQ ID NO: 789179 - DNA, 482 bp, Homo sapiens
  misc_feature: NA.48.29.C07.10.454.light.4.multim50
agggaaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagccgagtcgctggctccaactctggcaacacggccaccctggccatcagcagggtcgaagccggggatgaggccgactattactgtcaggtgtgggataagtggtggtgatcatccggtcttcggcggagggaccaaggttgaccgtcctaagtcagcccaaggctgccccctcggtcactctcgttcccrccctcct

SEQ ID NO: 789180 - DNA, 499 bp, Homo sapiens
  misc_feature: NA.12.67.G01.1.454.light.4.multim50
ttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtgggaccaaggtcaccgtcctacgtcagcccaaggcccaaccccactcgtcactctgttcccaccctcctctacgtcgtat

SEQ ID NO: 789181 - DNA, 441 bp, Homo sapiens
  misc_feature: NA.52.75.G09.2.454.light.4.multim50
agggcacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgacattgggatttctcatcgcttctctggctccaagtctggcaacacggcctccctcaccatctctgggctcctgactgaggacgaggctgattattactgcagctcatttacaagcaccaccactcctgtaatcttcggcggagggaccaagctgaccgtcctaggtcagcccaaggctgccccctcggtcactctgttcccgccctcctctatacgatcg

SEQ ID NO: 789182 - DNA, 482 bp, Homo sapiens
  misc_feature: NA.41.11.A11.1.454.light.4.multim50
aagggggaggaactgctcagttaggacccagacggaaccatggaagccccagcgcagcttctcttcctcctgctactctggctcccagataccactggagaaatagtggtgacgcagtctccagccaccctgtctgtgtctccaggggaaggagccaccctctcctgcagggccagtcagagtattagcagcagcttagcctggtaccagcagaagcctggccaggctcccaggctcctcgtctatggtgcatccaccagggccactggtatcccagccaggttcagtggcagtgggtctgggacagagttcactctcaccatcaccagcctgcagtctgaagattttggagtttatttctgtcaccagtataaggactggccttcgggtaacttttggtccgaggggaccgaagcgtggagatcagacgaactgtggctgcaccatctgtcttctacttcccgccatctgaatagtataga

SEQ ID NO: 789183 - DNA, 477 bp, Homo sapiens
  misc_feature: NA.52.59.F04.2.454.light.4.multim50
tagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggcggagggaccaaggtggagatcagacgaactgtggctgcaccatctgtcttcatcttccgccatctgatatacgatcg

SEQ ID NO: 789184 - DNA, 446 bp, Homo sapiens
  misc_feature: NA.49.37.D04.2.454.light.4.multim50
ttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaaggctccg

SEQ ID NO: 789185 - DNA, 442 bp, Homo sapiens
  misc_feature: NA.49.37.D04.3.454.light.4.multim50
tttgggtttgggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatcccgtacacttttggccaggggaccaggctggatatcagacgaacgtgtggctcgsa

SEQ ID NO: 789186 - DNA, 448 bp, Homo sapiens
  misc_feature: NA.49.37.D04.4.454.light.4.multim50
ttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgcctccgctcactttcggcggagggaccagggtggaggatcaaacgtaa

SEQ ID NO: 789187 - DNA, 483 bp, Homo sapiens
  misc_feature: NA.49.37.D04.1.454.light.4.multim50
tttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctgccccctcggtcactctcgttcccgtact

SEQ ID NO: 789188 - DNA, 481 bp, Homo sapiens
  misc_feature: NA.49.37.D04.6.454.light.4.multim50
ttgggtttgggggctgtgggtttgggtttggggactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgtttttcggcggagggaccaggctgaccgtcctgggtcagcccaaggctgccccctcggtcactctgttcccascctcctctct

SEQ ID NO: 789189 - DNA, 457 bp, Homo sapiens
  misc_feature: NA.49.37.D04.7.454.light.4.multim50
ttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtactacttttggccaggggaccaagcctggaaatcagacgaactgtggctgcaccatctat

SEQ ID NO: 789190 - DNA, 454 bp, Homo sapiens
  misc_feature: NA.49.37.D04.8.454.light.4.multim50
ttgggtttggggaggaactgctcagttaggacccagasggaaccatggaagccccagckcagcttctcttcctcctgctactctggctcccagataccacyggagaaakwgtgwtgwcrcagtctccwgccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggagatcaaacgaactgtggctgcaccatctgtctt

SEQ ID NO: 789191 - DNA, 481 bp, Homo sapiens
  misc_feature: NA.49.37.D04.9.454.light.4.multim50
ttgggtttgggggctgtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtagaaaatcacagaggaatattcggcggagggaccaagctgaccgtcctaggtcagcccaaggctsscccctcggtcactctcgttcccgyctcct

SEQ ID NO: 789192 - DNA, 458 bp, Homo sapiens
  misc_feature: NA.41.21.B10.1.454.light.4.multim50
aagggggagccagggggaggaactgctcagttaggacccagagggaaccatggaagccccagctcagcttctcttcctcctgctactctggctcccagataccaccggacaaattgtgttgacacagtctccagccaccctgtctttgtctccaggggaaagagccaccctctcctgcagggccagtcagagtgttagcaaccacttagcctggtaccaacagagacctggccagactcccagactcgtcatctatgatgcatccaagagggccactggcatcccagccaggttcagtggcagtgggtctgggacagacttcactctcaccatcagcagcctagagcctgaagattttgctagtttattactgtcagcagcgtggcgactggcctcgcatcaccttcggccaagggacacgactggagactagacgaactgtggctgcaccatctgtt

SEQ ID NO: 789193 - DNA, 480 bp, Homo sapiens
  misc_feature: NA.49.17.B06.1.454.light.4.multim50
aggaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtgtttataactatgtctcctggtaccaacaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaaccagcaacaattgggtgttcggcggagggaccaaactgaccgtcctaggtcagcccaaggctgccccctcggtcactctgttcccaccctcctt

SEQ ID NO: 789194 - DNA, 456 bp, Homo sapiens
  misc_feature: NA.49.17.B06.2.454.light.4.multim50
agggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctcggtcaccttccg

SEQ ID NO: 789195 - DNA, 479 bp, Homo sapiens
  misc_feature: NA.43.77.G11.1.454.light.4.multim50
aaagggaaagggggcttcagctgtgggcacaagaggcagcactcaggacagtctccagcatggcctggtcttctctcctcctcactctcctcgctcactgcacagggtcctgggcccagtctgtgctgacgcagccgccctcagtgtctggggccccagggcagagggtcaccatcccctgtactgggagcagtttcaacatcggggcaggtttggatgttaactggtaccagcaacttccaggatcagcccccaaactcctcatctatggtaccaccaatcggccctcaggagtccctgaccgattctctggctccaagtctggcatctcagccttcctggccatcactggactccaggtcgaggatgaggctgattattactgccaggcctgggacatcagcctgagtggccattatgtcttcggaaccgcgaccaaggtcaccgtcctaggtcagcccaaggccaacccctacygt

SEQ ID NO: 789196 - DNA, 457 bp, Homo sapiens
  misc_feature: NA.43.77.G11.2.454.light.4.multim50
aagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtcctaggtcagcccaaggctygccccctcggtctaccg

SEQ ID NO: 789197 - DNA, 474 bp, Homo sapiens
  misc_feature: NA.43.77.G11.3.454.light.4.multim50
aagggaaagggggctctgcttmagggamwgkgggcacaagaggcagcactcaggacagtctccagcatggcctggtcttctctcctcctcactctcctcgctcactgcacagggtcctgggcccagtctgtgctgacgcagccgccctcagtgtctggggccccagggcagagggtcaccatcccctgtactgggagcagtttcaacatcggggcaggtttggatgttaactggtaccagcaacttccaggakcagcccccaaactcstcatctatgstrmcamcartcggccctcgaggrgtccctgaccgattctctggctccaagtctggcayctcagcctycctggmcatcactgggctccaggctgaggatgaggctgactattactgccagtgctatgacagcgacctgagcggttcgatcttcggcggagggacgaagctgaccgtcctaagtcagcccaaggctcg

SEQ ID NO: 789198 - DNA, 459 bp, Homo sapiens
  misc_feature: NA.48.81.H04.2.454.light.4.multim50
aagagctgctcagttaggacccagagggaaccatggaaaccccagcgcagcttctcttcctcctgctactctggctcccagatactaccggagaagttctgttgacgcagtctccaggcaccctgtctttgtctccaggggaaagagccaccctctcctgcagggccagtcagactgttatcagcagctccttagcctggtaccagcagaaacctggccaggctcccaggctcctcatctatggtgcatccagcagggccgctggcatcccagacaggtttagtggcagtgggtctgggacagacttcactctcaccatcagcagactggagcctgaagattttgcagtgtatttctgtcagcagtatggtggctcacccgcgtacagttttggccaggggaccaagctggagatcaagcgaactgtggctgcaccatctgtcttcatcttcccgccat

SEQ ID NO: 789199 - DNA, 439 bp, Homo sapiens
  misc_feature: NA.48.81.H04.3.454.light.4.multim50
tccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgaccgtcctaggtcagaccccg

SEQ ID NO: 789200 - DNA, 467 bp, Homo sapiens
  misc_feature: NA.48.81.H04.4.454.light.4.multim50
agctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtaaccatctcctgctctggaagtagttccaacattgggaataattatgtctcctggtatcagcaactcccaggaacagcccccaaactcctcatttatgacaataataagcgaccctcaggaattcctgaccgattctctggctccaagtctggcacgtcagccaccctgggcatcaccggactccagactggggacgaggccgattattactgcggaacatgggataacagcccgagtggtggccgggtcttcggcggagggaccaagctgaccgtcctacgtcagcccaaggctgccccccggt

SEQ ID NO: 789201 - DNA, 456 bp, Homo sapiens
  misc_feature: NA.48.81.H04.5.454.light.4.multim50
ctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcggggggaccaggctgaccgtcggcggtcagcccaaggctgccccctcggtcactctgttcccvccctt

SEQ ID NO: 789202 - DNA, 467 bp, Homo sapiens
  misc_feature: NA.48.81.H04.6.454.light.4.multim50
agctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttttcacacctccatgaacaaggagtacttggcttggttccagcagaaaccagggcagcctcctaaactactcatttactcggcatccacccggaagtccgaggttcctgaccgattccgtggcagcgggtcgtgggacgagattttactctcaccatcactaccctgcaggctgaagatgtggcagtttattactgtcaacaatattattctactccgccgacgttcggccggggaccracrtggaaatcaaacgaactgtggctgcaccatctgtcttcatcttccccg

SEQ ID NO: 789203 - DNA, 464 bp, Homo sapiens
  misc_feature: NA.41.19.B08.2.454.light.4.multim50
agggggctggggtctcaggaggcagcgctctcgggacgtctccaccatggcctgggctctgctatccctcaccctcctcactcagggcacagggtcctgggcccagtctgccctgactcagcctgcctccgtgwctgggtctcctggacagtcgatcaccrtctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatataacaagcagcagcactctcgtggtattcggcggagggaccaagctgaccgtcctaggtcacgcccaaggcctcgtccccccg

SEQ ID NO: 789204 - DNA, 482 bp, Homo sapiens
  misc_feature: NA.41.19.B08.3.454.light.4.multim50
aggggaggtgatgcctccagggaaggggcttcggtgacctctgggctgatccttggtctcctgctcctcaggctcaccaggccccggctctgactcactggcatgtatttctccctctttccagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggccctccaggcggaggacgagggtgattatttctgcagctcatttacaaccacgccacaccttgctcttcggaactgggaccacggtcatcgtcctaggtcacgcccaagga

SEQ ID NO: 789205 - DNA, 454 bp, Homo sapiens
  misc_feature: NA.43.14.B03.2.454.light.4.multim50
tccgcgggcacgaccggtgctcgatttagtgcagatcgttaggggaaaggggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaaatggagtcccatcaagattcagcggcagtggatctggcacagctttcactctcaccgtcagcagcctgcagtctgaagattttgctaacttattactgtctactaagattcttcttaccctcggacgtcgcgmggacgacgtc

SEQ ID NO: 789206 - DNA, 510 bp, Homo sapiens
  misc_feature: NA.43.14.B03.1.454.light.4.multim50
tccgccacgatccgcggggatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgacctaggtcagcccaaggccaaccccactgtctactcttcccgta

SEQ ID NO: 789207 - DNA, 455 bp, Homo sapiens
  misc_feature: NA.43.34.D01.2.454.light.4.multim50
ttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccatctgtctt

SEQ ID NO: 789208 - DNA, 484 bp, Homo sapiens
  misc_feature: NA.48.59.F04.1.454.light.4.multim50
tagggattgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcattcctcccgccatctgatatgtatact

SEQ ID NO: 789209 - DNA, 424 bp, Homo sapiens
  misc_feature: NA.48.59.F04.2.454.light.4.multim50
tagggattggggagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 789210 - DNA, 537 bp, Homo sapiens
  misc_feature: NA.43.34.D01.1.454.light.4.multim50
ttgggtttgggcacgaccggtgctcgatttgggtttggggtttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccctacggtcactctgttcccrccctcctcactactcacac

SEQ ID NO: 789211 - DNA, 467 bp, Homo sapiens
  misc_feature: NA.48.59.F04.4.454.light.4.multim50
tagggattgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctgttcccccg

SEQ ID NO: 789212 - DNA, 460 bp, Homo sapiens; identical to SEQ ID NO: 789157
  misc_feature: NA.52.55.E11.1.454.light.4.multim50

SEQ ID NO: 789213 - DNA, 446 bp, Homo sapiens
  misc_feature: NA.52.55.E11.2.454.light.4.multim50
ttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcattttgggtgttcgggcggagggaccaagttgaccgtcctaggtcagcccaaggctcg

SEQ ID NO: 789214 - DNA, 456 bp, Homo sapiens
  misc_feature: NA.52.55.E11.3.454.light.4.multim50
ttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactc

SEQ ID NO: 789215 - DNA, 476 bp, Homo sapiens
  misc_feature: NA.52.55.E11.4.454.light.4.multim50
ttgggtttggggctgggcctcaggaagcagcatcgggggtgccgcagccatggcctggaccgctctccttctgagcctccttgctcactttacagggtctgcggcctcccatgacctgactcagtcactctcagtgtcggtggccctgggacagacggccactattacctgtgggggatacaacattaggaactaaaaatgtgcagtggtaccagcagaagccaggccaggcccctgtgttggtcatctatagggatcggaagacgggcctctgggattcctgagcgattctctggctccaactcggagaacacggccaccctgaccatcagaagtgcccaagtcggtgatgaggcagactattactgccaggtgtgggacaggtggtgttgtgatagttcggcggagggaccaagctgaccgtcctaagtcagcccaaggctcgccccctcggtcactctcgttcccgmcctcct

SEQ ID NO: 789216 - DNA, 459 bp, Homo sapiens
  misc_feature: NA.52.55.E11.6.454.light.4.multim50
ttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtca

SEQ ID NO: 789217 - DNA, 443 bp, Homo sapiens
  misc_feature: NA.52.55.E11.7.454.light.4.multim50
ttgggtttgggggagctgctcagttaggacccagagggaaccatggaaaccccagcgcagcttctcttcctcctgctactctggctcccagatatcaccggagaaattgtgttgacgcagtctccaggcaccctgtctctgtctccaggggagagagccaccctctcctgcaggaccagtcagagtattagcaacagttacttagcctggtaccagcagaatcctggccaggctcccaggctcctcatctatggtgcgtccagcagggccactggcatcccagacaggttcagtggcagtgggtctgggacagacttcactctcaccatcagcagggtggagcctgaggattttgcagtgtattgtcagcactatggtaggtcgacagtacacttttggccaggggaccaagctggagatcaaacgaactgtggctgcaccat

SEQ ID NO: 789218 - DNA, 436 bp, Homo sapiens
  misc_feature: NA.18.26.C04.2.454.light.4.multim50
tcagacccagtcgggacacagcatggacatgagggtccccgctcagctcctggggctcctgctgctctggytcycaggtkccagatgygacatccagatgacccagtctccakcytccstgkcwgcmtctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccgaaggtggacatacaaacgaactgtggctgcaccat

SEQ ID NO: 789219 - DNA, 447 bp, Homo sapiens
  misc_feature: NA.18.26.C04.1.454.light.4.multim50
tcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcatcttcccgcctac

SEQ ID NO: 789220 - DNA, 444 bp, Homo sapiens
  misc_feature: NA.49.54.E10.3.454.light.4.multim50
aacacacaarggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcagtggaagtggatctgggacacattttactttcaccatcagcggcctgcagcctgaagattttgcaacatattactgtcaacagtatgaagatctcccactcactttcggcggagggaccaaggtggagatcagacgaactgtggctgca

SEQ ID NO: 789221 - DNA, 471 bp, Homo sapiens
  misc_feature: NA.49.55.E11.2.454.light.4.multim50
ttgggtttgggggtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcaaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgtttttcggtcggagggaccaggctgaccgtcctgggtcagcccaaggctgccccctccggtccactctgttcccta

SEQ ID NO: 789222 - DNA, 446 bp, Homo sapiens; identical to SEQ ID NO: 789184
  misc_feature: NA.49.55.E11.3.454.light.4.multim50

SEQ ID NO: 789223 - DNA, 449 bp, Homo sapiens
  misc_feature: NA.49.55.E11.5.454.light.4.multim50
tttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacgtaacg

SEQ ID NO: 789224 - DNA, 494 bp, Homo sapiens
  misc_feature: NA.49.55.E11.6.454.light.4.multim50
ttgggtttgggtgctcgatttagagtatacatattgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgtcttcat

SEQ ID NO: 789225 - DNA, 456 bp, Homo sapiens
  misc_feature: NA.49.55.E11.7.454.light.4.multim50
ttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctggggacagagttcactctcaccatcagcagcctgcagtctgaagattttgcagtttattactgtcagcagtataatgtccgggctccggacactttcggcggagggaccaaggtggagatcaaacgaactgtggctgcaccatctgtctt

SEQ ID NO: 789226 - DNA, 435 bp, Homo sapiens
  misc_feature: NA.49.55.E11.8.454.light.4.multim50
ttgggtttggggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatcccgttacactttttaggccaggggaccgaggcgtggagtatcagacgaa

SEQ ID NO: 789227 - DNA, 480 bp, Homo sapiens
  misc_feature: NA.17.33.C11.1.454.light.4.multim50
tttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcctcctacg

SEQ ID NO: 789228 - DNA, 478 bp, Homo sapiens
  misc_feature: NA.12.85.H08.2.454.light.4.multim50
tcgcggggggggtctcaggaggcagcgctctcrggacrtctccaccatggcctgggctctgctgctcctcacyctcctcactcaggrcacagggtcctgggcccartctgccctgactcagcctgcctccgtgtctgggtctcctggacagtcgatcaccatytcctgcacyggraccaryagtgaygttggkmsttataacyttgtctcctggtacmaacarcacccaggcaaagcccccmaactcmtgatttatgaggkcactawkcggycctcaggrrtttctwatcgcttctctggctccgagtctggcaacacggcctccctgacaatctctgggctccaggctgaggacgaggcggattattactgttgctcatatgcgggtagtagcactttcgatgtcctattcggtcggagggaccgaagctgaccgtcctgggtcagcccaaggctcgccccctcggtcctactctcg

SEQ ID NO: 789229 - DNA, 499 bp, Homo sapiens
  misc_feature: NA.4.59.F04.2.454.light.4.multim50
tagggattgggcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaagggaccaaggtggaatcaaacgaactgtggctgcaccatctgtcttcta

SEQ ID NO: 789230 - DNA, 480 bp, Homo sapiens
  misc_feature: NA.40.38.D05.1.454.light.4.multim50
ttgggtttgggggcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggagggaccaagctgaccgtcctaggtcagcccaaggctcgccccctcggtcactcttcg

SEQ ID NO: 789231 - DNA, 454 bp, Homo sapiens
  misc_feature: NA.4.59.F04.1.454.light.4.multim50
tagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggcgtgggacagcagcactgaggtgttcggcggagggaccaagctgaccgtcctacgtcagcccaaggctgccccctcggtctac

SEQ ID NO: 789232 - DNA, 454 bp, Homo sapiens
  misc_feature: NA.40.38.D05.4.454.light.4.multim50
ttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactagaaaatcargccgggtggaggctgaggatgttggggtttattactgcatgcaaggtttataccttcctcggactttcggtccctcggaccgagagtggaktgtcaacgaactagttac

SEQ ID NO: 789233 - DNA, 455 bp, Homo sapiens
  misc_feature: NA.51.60.F05.2.454.light.4.multim50
gggaaaggggatataaaatctgtgctgtcaaactgattaggaactgactaccacctgcaggtcagggccaaggttatggggtcccaggttcacctcctcagcttcctcctcctttggatctctgtcagatagcagggcagaaacgacactcacgcagtctccagcattcatgtcagcgactcgaggagacaaagtcaacatctcctgcaaagccagccaggacattgatgatgatatcaactggatccaacagaaaccaggagaggctggtattttcgaatattcaagaacctactactctcgttcctggaatcccacctcgattcagtggcagcgggtatggaacagattttaccctcacaattaataacatagaatctgaggatgactgcatattacttctgtctacaacatgataatttcctacggtctaytttyggccaggggacccaagg

SEQ ID NO: 789234 - DNA, 491 bp, Homo sapiens
  misc_feature: NA.51.60.F05.3.454.light.4.multim50
gggaaagggggaggaactgctcagtcaggacccagacggaaccatggaagccccagcgcagcttctcttcctcctgctactctggctccsrgawagskactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtacaacaatatagtgacaggccgccatggacgttcggccgaagggaccgaaggtggaaagtggaaaaggaactaggtggctgcaccatactgtcttcatcttcccgccatctgatcgtagcact

SEQ ID NO: 789235 - DNA, 447 bp, Homo sapiens
  misc_feature: NA.51.60.F05.1.454.light.4.multim50
gggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagcccaaggctccgccccccg

SEQ ID NO: 789236 - DNA, 457 bp, Homo sapiens
  misc_feature: NA.40.87.H10.2.454.light.4.multim50
ttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttkgctgctcttatgcaggcagtttcgctctcgaagtgttcggcggagggaccgagctgaccgtcctacgtcagcccaaggctcg

SEQ ID NO: 789237 - DNA, 493 bp, Homo sapiens
  misc_feature: NA.40.87.H10.3.454.light.4.multim50
ttgggtttgkkgggkwwgsksagcttcagctgtggtagagaagacaggattcaggacaatctccagcatggccggcttccctctcctcctcaccctcctcactcactgtgcagggtcctgggcccagtctgtgctgactcagccaccctcagcgtctgasgacccccgggcagmrggtyaccrtytcttgttctggaagcarctccaayatcggaagtaattctgtatactggtaccagtgcctcccaggaaccggcccccaaaacttctcgtctatagggattatcagcggcccttaggggtccctgaccgattctctggctccaggtctggcacctcagcctccctggccatcagtgggctccggcccgaggatgaggcggattattattgtgtgtcatgggatgacaggaatgaatggtccggtggttcggcgggacgggaccaggctgaccgtccgtaggtcagccctaaggctcgccccctcggyyac

SEQ ID NO: 789238 - DNA, 513 bp, Homo sapiens
  misc_feature: NA.48.12.B01.1.454.light.4.multim50
tccgcggggaccggtgctcgatttagtgwgwgtagattccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaaacgaaactgtggctgcaccatctgtcttcatcttcccg

SEQ ID NO: 789239 - DNA, 476 bp, Homo sapiens
  misc_feature: NA.48.12.B01.2.454.light.4.multim50
tccgcgggcacgtccgcgggggctgctcagttaggacccagagggaaccatggaaaccccagcgcagcttctcttcctcctgctactctggctcccagatactaccggagaagttctgttgacgcagtctccaggcaccctgtctttgtctccaggggaaagagccaccctctcctgcagggccagtcagactgttatcagcagctccttagcctggtaccagcagaaacctggccaggctcccaggctcctcatctatggtgcatccagcagggccgctggcatcccagacaggtttagtggcagtgggtctgggacagacttcactctcaccatcagcagactggagcctgaagattttgcagtgtatttctgtcagcagtatggtggctcacccgcgtacagttttggccaggggaccaagctggagatcaagcgaactgtggctgcaccatctgtcttcatcttcccgccat

SEQ ID NO: 789240 - DNA, 470 bp, Homo sapiens
  misc_feature: NA.48.12.B01.3.454.light.4.multim50
tccgcgggcacgaccggtgctcgatttagcacrcgatmgwwgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcmcgaagattttgcggtttattactgtcagcagcgtgccaactggcctctcacgttcggcggagggaccaaggtggacatccaaacgaa

SEQ ID NO: 789241 - DNA, 466 bp, Homo sapiens
  misc_feature: NA.48.12.B01.6.454.light.4.multim50
tccgcgggcacgaccggtgctcgatttagakygmtagygaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaa

SEQ ID NO: 789242 - DNA, 486 bp, Homo sapiens
  misc_feature: NA.48.12.B01.8.454.light.4.multim50
tccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttttcacacctccatgaacaaggagtacttggcttggttccagcagaaaccagggcagcctcctaaactactcccatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccgggggaccgaacgtacggaaatacaaacgaactagtggctcgcaccatcgtgtcttctatcttccccg

SEQ ID NO: 789243 - DNA, 471 bp, Homo sapiens
  misc_feature: NA.48.12.B01.9.454.light.4.multim50
tccgcgggcacgaccggtgctcgatttagtgtcgtcgcaagagagagggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgttcagcagtatggaagttcacctcggacattcggccaggggaccaaggtggaaatcaaacgaa

SEQ ID NO: 789244 - DNA, 462 bp, Homo sapiens
  misc_feature: NA.19.67.G01.1.454.light.4.multim50
ttgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctcc

SEQ ID NO: 789245 - DNA, 441 bp, Homo sapiens
  misc_feature: NA.49.60.F05.1.454.light.4.multim50
gggaaagggggagtcagacccagtcaggacacagcatggacatgagggtccccgctcagctcctggggctcctgctgctctggctcccaggtgccaaatgtgacatccagatgacccagtctccttcccttttgtctgcatctgttggagacagagtcaccatcacttgccgggccactgagaacattaatcgctggttggcctggtatcagcagaaaccagggaaagcccctgaggccctcatctatctggcgtctagtttagagagtggggtcccatcaagattcagcggcaatggatctgggacagaattcactctcaccattagcagcctgcagcctgatgatcttgcaacttattactgccaacattataatagttatatgtacawttttggccaggggaccaagttggagatcaaacgaactagtggctgcacca

SEQ ID NO: 789246 - DNA, 457 bp, Homo sapiens
  misc_feature: NA.49.60.F05.2.454.light.4.multim50
agggaaagggggatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgttgggatttattactgcatgcaagctctacaagctcctcagctcactttcggcggagggaccaaggtggagatcaaacgaactgtggctgcacc

SEQ ID NO: 789247 - DNA, 458 bp, Homo sapiens
  misc_feature: NA.49.60.F05.4.454.light.4.multim50
gggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactcttccg

SEQ ID NO: 789248 - DNA, 451 bp, Homo sapiens
  misc_feature: NA.49.60.F05.5.454.light.4.multim50
gggaaagggggatcaggactcctcagttcacctcctcacaatgaggctccctgctcagctcctggggctgctaatgctctgggtctctggatccagtgggggtattgtgatgactcagtctccactctccctgcccgtcacccctggagagtcggcctccatctcctgcaggtctagtcagagcctcctatatagggatggatacaactatttggattggtacgtgcagaagccagggaagcctccacagctcctgatctatctggcttctaatcgggcctccggggtccctgacaggttcagcggcagtgtgtccggcacagattttacactaaaaatcagcagagtggaggctgacgatattggggtttattactgcatgcaagcaatacaccgcctcactttcggcggaggggaccacactggagatcaaacgaactgtggctgcacc

SEQ ID NO: 789249 - DNA, 464 bp, Homo sapiens
  misc_feature: NA.49.60.F05.3.454.light.4.multim50
gggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtcttcatcttcccgccta

SEQ ID NO: 789250 - DNA, 438 bp, Homo sapiens
  misc_feature: NA.49.60.F05.7.454.light.4.multim50
gggrraggksagtcccaaccaggacacagcatggacatgagggtccctgctcagctcctggggctcctgctgctctggctctcargtgccagatgtgtcatccagatgacccagtctccwtcctccctgtctgcatctataggagacagaatcaccatcacttgccgggcgagtcgagacattagcatgtatctgaattggtatcagcaaaaaccagggacagcccctaaactcctgatcctcgatgcatccactttggaracaggggtcccatcaaggttcagtggaagtggctctgggacagattttactttcaccatcagcaggctgcagcctgaagatattgcaacatattactgtcaacagtatgatmgtctcccgctcactttcggcgggggaccgaacggtggaggatccamgcgaactgtggctgcacca

SEQ ID NO: 789251 - DNA, 456 bp, Homo sapiens
  misc_feature: NA.4.33.C11.1.454.light.4.multim50
gttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggagatacaaacgaaacttacgg

SEQ ID NO: 789252 - DNA, 440 bp, Homo sapiens
  misc_feature: NA.4.33.C11.2.454.light.4.multim50
ttgggtttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactgtggctgcaccta

SEQ ID NO: 789253 - DNA, 458 bp, Homo sapiens
  misc_feature: NA.49.29.C07.1.454.light.4.multim50
agggaaagggggatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactagaaaatcagcagagtggaggctgaggatgttgggatttattactgcatgcaagctctacaagctcctcagctcactttcggcggagggaccaaggtggagatcaaacgaactgtggctgcacc

SEQ ID NO: 789254 - DNA, 483 bp, Homo sapiens
  misc_feature: NA.9.12.B01.1.454.light.4.multim50
tccgcggggattgttccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccgaaggtaggaaagtacaaacgaactagtggctgcaccatctgtcttctatcttccccgg

SEQ ID NO: 789255 - DNA, 486 bp, Homo sapiens
  misc_feature: NA.49.29.C07.4.454.light.4.multim50
agggaaaggggagagaagacaggattcaggacaatctccagcatggccggcttccctctcctcctcaccctcctcactcactgcgcagggtcctgggcccagtctgtgttgactcagccgccctcagcgtctgggacccccgggcagagggtcatcatctcttgttctggagggaaagggaacatcggaagtaactttgcttactggtaccaacaactcccaggaacggcccccaaattcctcttgtataggagtaatcagcggccctcaggggtccctgaccgattctctggctcccagtctggcacctcagcctccctggccatcagtggcctccggtccgaggatgaggctgattattattgtgcagcatgggatgacagcctgagtggtctcgtcttcggagctgggaccaaggtcaccgtcctaggtcagcccaaggccaaccccactgtcactctgttcccaccctcctctctctcgact

SEQ ID NO: 789256 - DNA, 467 bp, Homo sapiens
  misc_feature: NA.49.29.C07.5.454.light.4.multim50
  modified_base (464)..(464): a, c, t, g, unknown or other
agggaaaggggatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagactttcggccaagggaccaaggtggaaatcaaacgaactgtggctgcaccatctgtcttcatcttcccgccattccngta

SEQ ID NO: 789257 - DNA, 337 bp, Homo sapiens
  misc_feature: NA.49.29.C07.6.454.light.4.multim50
agggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgaggtcaccgtcctgggtcagcccaaggccaaccccactgtcactctgttcccgccctcctctctctcgact

SEQ ID NO: 789258 - DNA, 483 bp, Homo sapiens
  misc_feature: NA.13.38.D05.1.454.light.4.multim50
ttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacggaccgaacggtaggaaagtacaagacgaacgtagtaggcgtgcgaccaactctcgtcttctactcttcccgtccccg

SEQ ID NO: 789259 - DNA, 457 bp, Homo sapiens
  misc_feature: NA.13.38.D05.2.454.light.4.multim50
tttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgtc

SEQ ID NO: 789260 - DNA, 438 bp, Homo sapiens
  misc_feature: NA.48.25.C03.2.454.light.4.multim50
aagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgcaccta

SEQ ID NO: 789261 - DNA, 456 bp, Homo sapiens
  misc_feature: NA.48.25.C03.4.454.light.4.multim50
ctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctggaccgtcctaggtcagcccaaggcctcgcccccycggt

SEQ ID NO: 789262 - DNA, 445 bp, Homo sapiens
  misc_feature: NA.48.25.C03.6.454.light.4.multim50
tcacaagaggcagcgctctcgggacgtctccaccatggcctgggctctgctgctgttcatcctcctcactcaggacacagggtcctggrcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctcgccccctc

SEQ ID NO: 789263 - DNA, 439 bp, Homo sapiens
  misc_feature: NA.48.25.C03.7.454.light.4.multim50
tggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataattgtttgggtgtttgggcggagggaccaagctgaccgtcctaggtcacg

SEQ ID NO: 789264 - DNA, 459 bp, Homo sapiens; identical to SEQ ID NO: 788013
  misc_feature: NA.52.38.D05.1.454.light.4.multim50

SEQ ID NO: 789265 - DNA, 447 bp, Homo sapiens
  misc_feature: NA.52.38.D05.2.454.light.4.multim50
ttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtctaggtcagcccaaggctcgcccc

SEQ ID NO: 789266 - DNA, 457 bp, Homo sapiens
  misc_feature: NA.52.37.D04.1.454.light.4.multim50
ttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggctagtttgggtgttcgggcggagggaccaaggttgaccgtcctaggtcagcccaaggctcccgtccccccg

SEQ ID NO: 789267 - DNA, 472 bp, Homo sapiens
  misc_feature: NA.52.37.D04.2.454.light.4.multim50
ttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtcactcttcg

SEQ ID NO: 789268 - DNA, 458 bp, Homo sapiens
  misc_feature: NA.52.37.D04.4.454.light.4.multim50
ttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcacttcc

SEQ ID NO: 789269 - DNA, 462 bp, Homo sapiens
  misc_feature: NA.52.37.D04.5.454.light.4.multim50
ttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctcgccccctcggtctac

SEQ ID NO: 789270 - DNA, 436 bp, Homo sapiens
  misc_feature: NA.52.37.D04.6.454.light.4.multim50
ttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtcccctgtcctggtcatctatcaagatgtcaagcggccctcagggatccctgagcgattctctggctccaactctgggaacacagccactctgaccatcagcgggacccaggctatggatgaggctgactattactgtcaggcgtgggacagcaacactgtggtattcgggcggagggaccaagctgaccgtcctaggtcagcccaa

SEQ ID NO: 789271 - DNA, 530 bp, Homo sapiens
  misc_feature: NA.43.35.D02.1.454.light.4.multim50
ttgggtttgggcggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtcctaggtcagcccaaggctgccccctcggtcacgctgttcccaccctcctcactactcaca

SEQ ID NO: 789272 - DNA, 493 bp, Homo sapiens
  misc_feature: NA.43.35.D02.2.454.light.4.multim50
ttgggtttgggggctctgcttcagctgtgagcgcagaaggcaggactcgggacaatcttcatcatgacctgctcccctctcctcctcacccttctcattcactgcacagggtcctgggcccagtctgtcttgacgcagccgccctcagtgtctgcggccccaggacagaaggtcaccatctcctgcactggaagtacgtccaacattgggaattttttatgtatcctggtaccaacaagtcccaggaacagcccccaaactcctcgtttatcacaatagtcagcgaccgtcagggattcctgaccgattttctggctccaagtctggcacgtcagccaccctggtcatcaccggactccagactggggacgaggccgattattactgcggaacatgggataccagtccggagggttgggtgttcgggcggaggggaccaagttcgaccgtcctaggtcagcccaaggctgccccctcggtcactctgttccca

SEQ ID NO: 789273 - DNA, 462 bp, Homo sapiens
  misc_feature: NA.43.35.D02.3.454.light.4.multim50
ttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtggaaatacaaacgaactagtggctgcaccatctgtcttcatacttccc

SEQ ID NO: 789274 - DNA, 464 bp, Homo sapiens
  misc_feature: NA.43.35.D02.4.454.light.4.multim50
tttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggcccaacccctacg

SEQ ID NO: 789275 - DNA, 465 bp, Homo sapiens
  misc_feature: NA.43.35.D02.6.454.light.4.multim50
ttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggttcaggggaccgaasttagwacaatcaactacgwacgtagtggcgtcgtcaccawctcttcg

SEQ ID NO: 789276 - DNA, 495 bp, Homo sapiens
  misc_feature: NA.49.22.B11.1.454.light.4.multim50
agggcacgaccggtgctcgatttagacgacagctcagggggaggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaaacctggccaggttcccaggctcctcgtctatgatgcgtccatcagggccactggcatcccagccaggttcagtggcagtgggtctgggacagacttcactctcaccatcagcagcctagagcctgaagactttgcagtttattactgtcagcagcgtagcaatttgatcaccttcggccaagggacacgactggaaattaaacgaactgtggctgcaccatctgtcttcatcttcccgccatctcg

SEQ ID NO: 789277 - DNA, 470 bp, Homo sapiens
  misc_feature: NA.49.22.B11.2.454.light.4.multim50
agggcacgaccggtgctcgatttagtagtgtagattcgagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacactattttactttcaccatcagcagactgcagcctgaagatattgcaacatattactgtcaaacagtatgataatctcccgctcactttcggcggagggaccaaggtggagatcaaacgaactagt

SEQ ID NO: 789278 - DNA, 533 bp, Homo sapiens
  misc_feature: NA.49.22.B11.4.454.light.4.multim50
agggcacgaccggtgctcgatttagcgagacgcgcagggggagkskgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccasgsccctgtgttggtcgtccatgatgacagcgacccggccctcagggatccctgagcgattttctggctccaagtctagggaacacggccaccctgacccgtcagcagggtcgaaggccggggatggaggccgactatatctgtcaggtgtgggatagtagtagtgctcgttccgggggtgttcgggcggagggaccaaggytgaccgtcgtwggtcagcccaaggctgccccctcggtcactctcgttcccgccctcctctctctcgactcg

SEQ ID NO: 789279 - DNA, 488 bp, Homo sapiens
  misc_feature: NA.40.37.D04.1.454.light.4.multim50
ttgggtttggggataaaagctcagctctaaccttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggtcccgtcgggaccgacgagtggagtgtcaaacgaaactagtcr

SEQ ID NO: 789280 - DNA, 451 bp, Homo sapiens
  misc_feature: NA.49.77.G11.1.454.light.4.multim50
aagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgttt

SEQ ID NO: 789281 - DNA, 470 bp, Homo sapiens
  misc_feature: NA.49.77.G11.2.454.light.4.multim50
aagggaaaggggctgcttmagggamwgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggctttgatgtccactggtaccagcagcttccaggaacagcccccaaactcctcatctatggtaacaacaatcggccctcaggggtccctgaccgattctctgcctccaagtctgccacctcggcctccctggccatcactgggctccaggctgaagatgaggctgattattactgccagtcctatgacagcaccatgagtcgttccgtggtcttcggcggagggacccaggcctgacccgtcctaggtcagcccaa

SEQ ID NO: 789282 - DNA, 459 bp, Homo sapiens
  misc_feature: NA.49.77.G11.3.454.light.4.multim50
aagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactcgtcacttcs

SEQ ID NO: 789283 - DNA, 443 bp, Homo sapiens
  misc_feature: NA.49.77.G11.4.454.light.4.multim50
aagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcacc

SEQ ID NO: 789284 - DNA, 448 bp, Homo sapiens
  misc_feature: NA.49.77.G11.5.454.light.4.multim50
aagggaaaggggactgatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgttgggatttattactgcatgcaagctctacaagctcctcagctcactttcggccggagggacccgaaggtggaggataacg

SEQ ID NO: 789285 - DNA, 476 bp, Homo sapiens
  misc_feature: NA.43.23.C01.2.454.light.4.multim50
tagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactctcgtt

SEQ ID NO: 789286 - DNA, 495 bp, Homo sapiens
  misc_feature: NA.51.34.D01.1.454.light.4.multim50
ttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcactctcgttcccaccctcctctcgtagcact

SEQ ID NO: 789287 - DNA, 480 bp, Homo sapiens
  misc_feature: NA.51.34.D01.3.454.light.4.multim50
ttgggtttgggagggggtcaggctggaattgggtttggggagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcggggggaccgaaggtggagatcaagcgaactgtggctgcaccatctgttt

SEQ ID NO: 789288 - DNA, 444 bp, Homo sapiens
  misc_feature: NA.51.34.D01.4.454.light.4.multim50
ttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccgaaggtggagatcaagcgaactgtggctgcaccta

SEQ ID NO: 789289 - DNA, 461 bp, Homo sapiens; identical to SEQ ID NO: 788904
  misc_feature: NA.51.34.D01.6.454.light.4.multim50

SEQ ID NO: 789290 - DNA, 455 bp, Homo sapiens
  misc_feature: NA.51.34.D01.7.454.light.4.multim50
ttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactc

SEQ ID NO: 789291 - DNA, 473 bp, Homo sapiens
  misc_feature: NA.51.34.D01.8.454.light.4.multim50
ttgggtttggggtgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggccctggggacgttcggccaagggaccgaaggtggaaatacaaacgaactagtggctgcaccatctgtcttcta

SEQ ID NO: 789292 - DNA, 461 bp, Homo sapiens
  misc_feature: NA.48.38.D05.1.454.light.4.multim50
ttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggcctgccccccg

SEQ ID NO: 789293 - DNA, 466 bp, Homo sapiens
  misc_feature: NA.48.38.D05.2.454.light.4.multim50
ttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcgggagggaccaagctgaccgtcctacggtcagcccaaggctckcgccctc

SEQ ID NO: 789294 - DNA, 452 bp, Homo sapiens
  misc_feature: NA.48.38.D05.4.454.light.4.multim50
ttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctcgccccccg

SEQ ID NO: 789295 - DNA, 471 bp, Homo sapiens
  misc_feature: NA.48.38.D05.6.454.light.4.multim50
ttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctggttcggcggagggaccaagctgaccgtcctaagtcagcccaaggcctgccccctcggtctactcttccg

SEQ ID NO: 789296 - DNA, 469 bp, Homo sapiens
  misc_feature: NA.48.38.D05.7.454.light.4.multim50
ttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgtactttcggcgggagggaccaaggtggaggtcaaacgaactgtggctgcaccatctgtctt

SEQ ID NO: 789297 - DNA, 497 bp, Homo sapiens
  misc_feature: NA.48.38.D05.8.454.light.4.multim50
ttgggtttgggggagctacaacaggcaggcaggggcagcaagatggtgttgcagacccaggtcttcatttctctgttgctctggatctctkgkgyytrsggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacggaactgtggctgcacctatctgtcttcatcttcccgccatctgatatgtatact

SEQ ID NO: 789298 - DNA, 468 bp, Homo sapiens
  misc_feature: NA.48.38.D05.9.454.light.4.multim50
ttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagccaaggctgccccctcggtcactctgttcccvcct

SEQ ID NO: 789299 - DNA, 460 bp, Homo sapiens
  misc_feature: NA.52.34.D01.2.454.light.4.multim50
ttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtctaccg

SEQ ID NO: 789300 - DNA, 457 bp, Homo sapiens
  misc_feature: NA.52.34.D01.4.454.light.4.multim50
ttgggtttggggggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttcccg

SEQ ID NO: 789301 - DNA, 446 bp, Homo sapiens
  misc_feature: NA.52.34.D01.6.454.light.4.multim50
ttgggtttggggcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagtattttgctaacttattactgtcaacaccttaatagttactccttcactttcggccctgggaccaaagtggacatcaaacgaactgtggctgcaccatctgtt

SEQ ID NO: 789302 - DNA, 479 bp, Homo sapiens
  misc_feature: NA.52.34.D01.7.454.light.4.multim50
ttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaatttgggggttttcggcggagggaccaaggtgaccgtcctacgtcagcccaaggctgccccctcggtcacttcygtt

SEQ ID NO: 789303 - DNA, 473 bp, Homo sapiens
  misc_feature: NA.52.34.D01.3.454.light.4.multim50
ttgggtttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcattcccgcmta

SEQ ID NO: 789304 - DNA, 472 bp, Homo sapiens
  misc_feature: NA.48.52.E08.2.454.light.4.multim50
agagagaaaggggctgggcctcaggaagcagcatcggggggtgccgcagccatggcctggaccgctctccttctgagcctccttgctcactttacagattctgtggcctcctatgaattgactcagcccttctcagtgtcggtggccctggggcagacggccaggatgacctgtgggggaaacaaaattggaagtaaagatgtgcactggtatcagcacaagccaggccaggcccctctactggtcatttatagggataccaatcggccctctgggatccctgagcggatctctggctccaactcggggaacacggccaccctgaccatcagcggggcccaagccggggatgaggctgactatttctgtcaggtgtgggacagcagcagtgtgattttcggcggcgggaccaagctgaccgtcctaggtcagcccaaggctgccccctcggtcactctgttcccgccctcct

SEQ ID NO: 789305 - DNA, 456 bp, Homo sapiens
  misc_feature: NA.48.52.E08.3.454.light.4.multim50
agagagaagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatcctgtctt

SEQ ID NO: 789306 - DNA, 342 bp, Homo sapiens; identical to SEQ ID NO: 787837
  misc_feature: NA.41.38.D05.2.454.light.4.multim50

SEQ ID NO: 789307 - DNA, 461 bp, Homo sapiens
  misc_feature: NA.41.38.D05.1.454.light.4.multim50
ttgggtttggggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcaccatctgtcttcatttccccg

SEQ ID NO: 789308 - DNA, 494 bp, Homo sapiens
  misc_feature: NA.49.68.G02.3.454.light.4.multim50
ctggggagcctagctgtgctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactctcgttcccaccctcctctctctcgact

SEQ ID NO: 789309 - DNA, 451 bp, Homo sapiens
  misc_feature: NA.49.68.G02.4.454.light.4.multim50
ctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcgtt

SEQ ID NO: 789310 - DNA, 455 bp, Homo sapiens
  misc_feature: NA.49.68.G02.5.454.light.4.multim50
aggaactgctcagttaggacccagagggaaccatggaagccccagctcagcttctcttcctcctgcttctctggctcccagatattaccggagaaattgtgttgacgcagtctccagccaccctgtctttgtctccaggggaaagagccaccctctcctgcagggccagtcagagtgttaacatctacttagtctggtaccaacagaaagctggccacgctcccaggctcctcatctatgatacatccaccagggcccctggcatcccagcccaggttcagtggcagtgggtctgggacagacttcactctcaccatcagcagcttagagcctgaagattttgctagtttattactgtcagcagcgtatcaccgggatcaccttcggcccaagggaccccgactggagattaagcgaactgtggctgcaccatctgtcttcatccttcccgccta

SEQ ID NO: 789311 - DNA, 432 bp, Homo sapiens
  misc_feature: NA.49.68.G02.6.454.light.4.multim50
aggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 789312 - DNA, 476 bp, Homo sapiens
  misc_feature: NA.4.57.F02.1.454.light.4.multim50
ttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcactctgttccctatta

SEQ ID NO: 789313 - DNA, 462 bp, Homo sapiens
  misc_feature: NA.53.53.E09.2.454.light.4.multim50
ttgggtttgggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctggtcacttccg

SEQ ID NO: 789314 - DNA, 446 bp, Homo sapiens
  misc_feature: NA.53.53.E09.3.454.light.4.multim50
ttgggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggaggataaatatacttgctggtatcagcagaagccaggccagtcccctgtgttggtcatctatcaagataggaagcggccctcagggatccctgagcgattctctggctccaactctgggaacacagccactctgaccatcagcgggacccaggctatggatgaggctgactattattgtcaggcgtgggacagcaaccctgattgggtgttcggcggagggaccaaactcgaccgtcctaggtcagcccaaggctccs

SEQ ID NO: 789315 - DNA, 450 bp, Homo sapiens
  misc_feature: NA.4.57.F02.2.454.light.4.multim50
ttgggtttgggggcaggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcaccat

SEQ ID NO: 789316 - DNA, 443 bp, Homo sapiens
  misc_feature: NA.52.81.H04.2.454.light.4.multim50
aagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattggcaataattttgtgtcctggtaccagcaactcccaggcacagcccccaaactcctcatttatgacaatgataagcgaccctcagggatacctgaccgattctctggctccaagtctggcacgtcagccaccctgggcatcaccggactccagactggggacgaggccgattattactgcggaacatgggatagcagcctgagtgatgccagggtgttcggcggagggaccaagctgaccgtccga

SEQ ID NO: 789317 - DNA, 450 bp, Homo sapiens
  misc_feature: NA.52.81.H04.3.454.light.4.multim50
ctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaaccccactgtctactctcg

SEQ ID NO: 789318 - DNA, 473 bp, Homo sapiens
  misc_feature: NA.52.81.H04.5.454.light.4.multim50
tctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgtcagctcatacacaaacagaaacacgttgggtgttcgggcggtcgggaccaaactgaccgtccttcggtcacgacccaaggccgtgccccctcggtccactctcgttcccgta

SEQ ID NO: 789319 - DNA, 453 bp, Homo sapiens
  misc_feature: NA.41.55.E11.1.454.light.4.multim50
ttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcacggtccaac

SEQ ID NO: 789320 - DNA, 471 bp, Homo sapiens
  misc_feature: NA.12.71.G05.1.454.light.4.multim50
tgggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccaccctt

SEQ ID NO: 789321 - DNA, 482 bp, Homo sapiens
  misc_feature: NA.41.55.E11.3.454.light.4.multim50
ttgggtttggggctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccaccctcctcta

SEQ ID NO: 789322 - DNA, 482 bp, Homo sapiens
  misc_feature: NA.41.55.E11.4.454.light.4.multim50
tttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaatttcagggtatttggcggagggaccaagctgaccgtcctgggtcagccaaggctcgccccctcggtcactmccgttcccgt

SEQ ID NO: 789323 - DNA, 464 bp, Homo sapiens
  misc_feature: NA.41.55.E11.5.454.light.4.multim50
ttgggtttggggctgggcctcaggaagcagcatcggaggtgcctcagccatggcgtggatccctctcttcctcggcgtccttgcttcctgcacagtttccgtggcctcctcggaattgactcaggcaccctcagtgtccgtgtctccaggacagacagccagaatcacctgctctggagacacgttgggggagacatttgcttcctggtatcaacagaggccaggccagtcccctatcctggtcatctttcaggatgacaaacggccctctggcatccctgaacgcttctctggttccaggtcaggaaacagagccactctaaccatcaccgagacccaggctgtcgatgaggctgactattactgtcaggcctgggacagaaacactggcatattcggcggagggaccaagctgaccgtcctacgtcagcccaaggctgccccctcggtcactctgttcccgt

SEQ ID NO: 789324 - DNA, 342 bp, Homo sapiens; identical to SEQ ID NO: 787837
  misc_feature: NA.41.55.E11.6.454.light.4.multim50

SEQ ID NO: 789325 - DNA, 496 bp, Homo sapiens
  misc_feature: NA.49.82.H05.1.454.light.4.multim50
cacgaccggtgctcgatttagtcgagctctctcgcggstggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccgtcctaggtcagcccaaggctgccccctcggtmcg

SEQ ID NO: 789326 - DNA, 460 bp, Homo sapiens
  misc_feature: NA.49.45.E01.1.454.light.4.multim50
ctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggctttgatgtccactggtaccagcagcttccaggaacagcccccaaactcctcatctatggtaacaacaatcggccctcaggggtccctgaccgattctctgcctccaagtctgccacctcggcctccctggccatcactgggctccaggctgaagatgaggctgattattactgccagtcctatgacagcaccatgagtcgttccgtggtcttcggcggagggacccagctgaccgtcctacggtcacgcccaacggccg

SEQ ID NO: 789327 - DNA, 450 bp, Homo sapiens
  misc_feature: NA.49.45.E01.2.454.light.4.multim50
tggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaaggcccccaaactcttcatttatgatgtcactaatcggccctcaggggtccctgatcgcttctctgcctccaagtctggcaacacggcctccctgaccatctctgggctccaggctgaggatgaggctcattattattgttgctcatatgcaggcaacttcgcttttgtcttcggaactgggaccgaggtcaccgtctgggtcagcccaaggcccaacccmcta

SEQ ID NO: 789328 - DNA, 430 bp, Homo sapiens
  misc_feature: NA.49.45.E01.3.454.light.4.multim50
caggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagtattttactttcaccatcagcaggctgcagcctgaagatattgcaacatattactgtcaacagtatgatcgtctcccgctcactttcggcggggggaccgaaggtggagatcaagcgaactgttggcg

SEQ ID NO: 789329 - DNA, 461 bp, Homo sapiens; identical to SEQ ID NO: 787926
  misc_feature: NA.49.45.E01.5.454.light.4.multim50

SEQ ID NO: 789330 - DNA, 433 bp, Homo sapiens
  misc_feature: NA.49.45.E01.7.454.light.4.multim50
atcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgktgkggatttattactgcatgcaagctctacaagctcctcagctcactttcggcggagggaccaaggtggagatcaaacgaa

SEQ ID NO: 789331 - DNA, 460 bp, Homo sapiens
  misc_feature: NA.40.59.F04.2.454.light.4.multim50
tagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtggggtctgggacagacttcactctcacccatcagcggcctagagcctgaagactttgcagtttattactgtcagcagcgtaccaactggccrctcactttcggcggagggaccgaaggtggasgatcaaacgaactgtggctgcaccatctgtcttcatt

SEQ ID NO: 789332 - DNA, 442 bp, Homo sapiens
  misc_feature: NA.40.59.F04.1.454.light.4.multim50
tagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagaccccgccg

SEQ ID NO: 789333 - DNA, 499 bp, Homo sapiens
  misc_feature: NA.51.55.E11.3.454.light.4.multim50
ttgggtttgggcacaccggtgctcgtttagcacacgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactcg

SEQ ID NO: 789334 - DNA, 452 bp, Homo sapiens
  misc_feature: NA.51.55.E11.4.454.light.4.multim50
ttgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcggggggaccaagctgaccgtcctcggtcagcccaaggctgccccctcggtcc

SEQ ID NO: 789335 - DNA, 449 bp, Homo sapiens
  misc_feature: NA.51.55.E11.5.454.light.4.multim50
ttgggtttggggagagctgctcagttaggacccagagggaaccatggaaaccccagcgcagcttctcttcctcctgctactctggctcccagatacctccggtgagattgtgttgacgcagtctccaggcaccctgtctttgtttccaggggacagagccaccctctcctgcagggccagtcagagttttagcagcaactacttggcctggtaccagcagaaacctggccaggctcccaggctcctcatctatggtgcatccagcagggccgctggcatcccagacaggttcagtggcagtgggtctgggacagacttcagtctcaccatcagcggactggagcctgaagattttgcagtgtattactgtcagcaccatggtagctcatcccggtacacttttggccgggggaccaagctggagatcaaacgaactgtggctgcaccat

SEQ ID NO: 789336 - DNA, 459 bp, Homo sapiens
  misc_feature: NA.51.55.E11.6.454.light.4.multim50
ttgggtttggggctggscstcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctcggtcactctgtt

SEQ ID NO: 789337 - DNA, 467 bp, Homo sapiens
  misc_feature: NA.51.55.E11.7.454.light.4.multim50
ttgggtttggggagtctcagtcaggaywsrgywtgggrcwttcsmkggtccccgctcagctcctggggctcctgctactctggctccgaggtgccagatgtgacatccagatgacccagtctccatcctccctgtctgcatctgtaggagacagagtcaccatcacttgycgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgctaacttactactgtcaacagagttacagtacccctcagctcactttcggcggagggaccaaggtggagatcaaacgaactgtggctgcaccatctgtcttcatcttcccgcccat

SEQ ID NO: 789338 - DNA, 436 bp, Homo sapiens
  misc_feature: NA.51.55.E11.9.454.light.4.multim50
ttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcacttttcggtcgggggaccgaaggtggagatcaagcgaactgtggctgca

SEQ ID NO: 789339 - DNA, 464 bp, Homo sapiens
  misc_feature: NA.48.86.H09.1.454.light.4.multim50
tttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcgccccctcc

SEQ ID NO: 789340 - DNA, 486 bp, Homo sapiens
  misc_feature: NA.48.86.H09.3.454.light.4.multim50
ttgggtttggggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccgccctcctctatgtatact

SEQ ID NO: 789341 - DNA, 440 bp, Homo sapiens
  misc_feature: NA.48.86.H09.4.454.light.4.multim50
ttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagaccccgc

SEQ ID NO: 789342 - DNA, 447 bp, Homo sapiens
  misc_feature: NA.40.83.H06.1.454.light.4.multim50
tcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagaccccg

SEQ ID NO: 789343 - DNA, 463 bp, Homo sapiens; identical to SEQ ID NO: 788729
  misc_feature: NA.48.86.H09.6.454.light.4.multim50

SEQ ID NO: 789344 - DNA, 455 bp, Homo sapiens
  misc_feature: NA.48.86.H09.7.454.light.4.multim50
ttgggtttggggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgctaacttattactgtctgcacgattacaattaccctcggacgttcggccaagggaccraaggtggaagtacaaacgaaactaggtggctgcacgcacctaa

SEQ ID NO: 789345 - DNA, 450 bp, Homo sapiens
  misc_feature: NA.48.86.H09.8.454.light.4.multim50
ttgggtttgggggaaccatggaagccccagcgcagcttctcttcctcctgctactctggctcccagaaagcaccggagacattgaactgacgcagtctccaggcaccctgtctttgtctccaggggaaagagccaccctctcctgcagggccggtcggagtctttccagcacctacttagcctggtaccaacaaaaagctggccaggctcccaggctcctcatatatgatgtttctaccagggccactggcattccagacaggttcagtggcagtgggtctggggacagacttcactctcaccatcaacagattggagcctgaagactctgcagtctatttctgtcagcaatatcgcagttcagtctcgtacacttttggccaggggaccacgctggagatcaaacgaactgtggctgcaccatctgtcttcatcttcccgccatctgat

SEQ ID NO: 789346 - DNA, 480 bp, Homo sapiens
  misc_feature: NA.48.86.H09.9.454.light.4.multim50
ttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctggggcgagagggccaccatctactgcaagtccagccagagtcttttttcacacaaccaatgagaagaactacttagcttggtaccagcagagaccaggacaacctcctaagttgctcttttactgggcgtcttcccggggagtccggggtccctgaccgattcagtgccagcgggtctgggacagacttcactctcaccatcagcggcctgcaggctgaagatgtggctagtttattactgtcagctactgttttggcggtttctccggtactttcggcgggagggaccgaaggtgggaggtcaaacgaactgtggctgcaccatctgtcttct

SEQ ID NO: 789347 - DNA, 485 bp, Homo sapiens
  misc_feature: NA.51.27.C05.1.454.light.4.multim50
aagggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctcggtcactctcgttcccccgtcccc

SEQ ID NO: 789348 - DNA, 462 bp, Homo sapiens
  misc_feature: NA.51.27.C05.4.454.light.4.multim50
agggtttggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactatttattgtacaatcaacagacaccaattggtacttatgtcttcggaactgcgaccaaggtcaccgtcctgggtcagcccaaggccaaccccactgtcactctcg

SEQ ID NO: 789349 - DNA, 456 bp, Homo sapiens
  misc_feature: NA.48.41.D08.1.454.light.4.multim50
agctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccgaacgtggaaatcaaacgaactagtggctgcaccatctgtctt

SEQ ID NO: 789350 - DNA, 434 bp, Homo sapiens
  misc_feature: NA.48.41.D08.2.454.light.4.multim50
ctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgstwatmmctatgtctcctggtaccaacarcacscwggcaaagcccccaaactcatgatttatgatrtcactaagcggccctcaggggtccctgmtcgcttctctggctcccagtctggcaacacggcctccctgaccatctctgggctccaggctgargatgaggctgattattactgctgctcatatgcagscagctacactttggtsttcggaackgaggaccaagstsactcgtccgaggtca

SEQ ID NO: 789351 - DNA, 452 bp, Homo sapiens
  misc_feature: NA.48.41.D08.3.454.light.4.multim50
agagctctggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcaccatcttcg

SEQ ID NO: 789352 - DNA, 470 bp, Homo sapiens
  misc_feature: NA.48.41.D08.6.454.light.4.multim50
agtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataagtggtggtgatcatccggtcttcggcggagggaccaagttgaccgtcctaagtcagcccaaggctgccccctcggtcactctgttcccacctcctcta

SEQ ID NO: 789353 - DNA, 441 bp, Homo sapiens
  misc_feature: NA.48.41.D08.7.454.light.4.multim50
agtcagacccagtcaggacacagcatggacatgagggtccccgctcagctcctggggctcctgctgctctggctcccaggtgccaaatgtgacatccagatgacccagtctccttccaccctgtctgcctctgtaggagacagggtcaccatcacttgccgggccagtcagagtattagtgactggttggcctggtatcagcagaaaccagggaaagcccctaacctcctgatctatcaggcatctactttagaaagtggggtcccatcaaggttcagcggcagtggatctgaaacagaattcactctcaccatcagcagcctgcagcctgatgattatgcgacttawtactgccaacaatacactagtttgtggacgttcggccaggggaccaaggtaggaaatacaaacgaaactgtggctgcaccatctgtcttcatt

SEQ ID NO: 789354 - DNA, 468 bp, Homo sapiens
  misc_feature: NA.48.15.B04.1.454.light.4.multim50
tccgcggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccggggaccaacgtggaaatcaaacgaactgtggctgcaccatctgtcttctaccc

SEQ ID NO: 789355 - DNA, 485 bp, Homo sapiens
  misc_feature: NA.48.15.B04.3.454.light.4.multim50
tccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaactatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcaatgcaaggctcacactggcctccgtggacgttcggtccaagggacccgggtacgggaaataaaacggaaactacggtaggcgtcgcgaccatctgtcttctatt

SEQ ID NO: 789356 - DNA, 473 bp, Homo sapiens
  misc_feature: NA.48.15.B04.4.454.light.4.multim50
tccgcgggcacgaccggtgctcgatttagatcrtctgatagttgggtttggggggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagtattttacattttattactgtcagcagtatcgtaagtggactccgacgtttggccaagggaccaagggtggaagtcaaacgaact

SEQ ID NO: 789357 - DNA, 447 bp, Homo sapiens
  misc_feature: NA.52.41.D08.6.454.light.4.multim50
ctggggtctcaggaggcagcactctcgggacgtctccaccatggcctgggctctgctcctcctcagcctcctcactcagggcacaggatcctgggctcagtctgccctgrctcagcctcgctcagtgtccgggtctcctggacagtcagtcaccatctcctgcactggcaccaacagtgatttttggtggttatgattctgtcttctggtaccaacggcacccaggcaaagtccccaaactccatgattactgatatcaataagaggccctcaggggtccctgatcgcttctctggctccaagtctggcaacacggcctccctgaccatctctgggctccaggctgaggatgaggctgaatatttctgctgctcatatgcaggcggctacacttatgttcttcggaacttcgggacccaggtccaccgtcctaggtcagcccaagga

SEQ ID NO: 789358 - DNA, 467 bp, Homo sapiens
  misc_feature: NA.49.42.D09.5.454.light.4.multim50
agggaaaggggggcatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagactttcggccaagggaccaaggtggaaatcaaacgaactgtggctgcaccatctgttcttctactcttccccgccat

SEQ ID NO: 789359 - DNA, 455 bp, Homo sapiens
  misc_feature: NA.49.42.D09.6.454.light.4.multim50
agggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactt

SEQ ID NO: 789360 - DNA, 471 bp, Homo sapiens
  misc_feature: NA.49.28.C06.5.454.light.4.multim50
ctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacaataaacacttgggtgttcggcggcgggaccaaactcgaccgtcctacgtcagcccaaggctcgccccctcggtcactctcgttcccgt

SEQ ID NO: 789361 - DNA, 482 bp, Homo sapiens
  misc_feature: NA.48.57.F02.1.454.light.4.multim50
ttgggtttggggtcagcttcagctgtggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatggagggtgatttttattgtgctgtttgggatgacgacatgaatggttcgtattttcggcggtagggaccaaactgaccgtcctgggtcagcccaaggctcgccccctcggtcctac

SEQ ID NO: 789362 - DNA, 443 bp, Homo sapiens
  misc_feature: NA.48.57.F02.3.454.light.4.multim50
ttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggtcggagggaccaacgctgaccgtcctaacgtcagacccgac

SEQ ID NO: 789363 - DNA, 488 bp, Homo sapiens
  misc_feature: NA.49.87.H10.3.454.light.4.multim50
ttgggttggggtggggagcttgggtttgggggtgggtccaggaggcagaactctgggtgtctcaccatggcctggatccctctacttctccccctcctcactctctgcacaggctctgaggcctcctatgagttgatccagccaccctcggtgtcagtgtccccaggacagacggccaggattctttgctctggagatgcgttggcaaaacagtttgcttattggttccagcagaagccaggccaagcccctgtggtggtgatttataaaggctttcagaggccctcagggatccctgagcgattctctgggtccagctcagggacaacagccatgttgaccatcagtggagtccaggcagaagacgaggctgactattattgtcaatcagcagacaacactgttgtttctgtgtttttcggcggtcgggaccaggctgaccgtcctgggtcagcccaaggctgccccctcggtcactctgttcccta

SEQ ID NO: 789364 - DNA, 483 bp, Homo sapiens
  misc_feature: NA.48.57.F02.5.454.light.4.multim50
ttgggtttgggctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctcgcccccgc

SEQ ID NO: 789365 - DNA, 452 bp, Homo sapiens
  misc_feature: NA.49.87.H10.5.454.light.4.multim50
tttgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggcttcgttttcggtccgasggggaccaagctggagatcaagcgaactgtggctgcaccatctgtt

SEQ ID NO: 789366 - DNA, 443 bp, Homo sapiens
  misc_feature: NA.49.87.H10.8.454.light.4.multim50
ttgggtttkgggkywggagtsagtcccaaccaggacacagcatggacatgagggtccctgctcagctcctggggctcctgctrctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatcaagcgaactgtggctgca

SEQ ID NO: 789367 - DNA, 517 bp, Homo sapiens
  misc_feature: NA.49.87.H10.9.454.light.4.multim50
ttgggtttgggggtgctcgatttagtctagcgactttgggtttgggggctgtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagrgaccaagctgaccgtcctaggtcacgcccaaggctgccccctcggtcactctcgttcccaccctcct

SEQ ID NO: 789368 - DNA, 445 bp, Homo sapiens
  misc_feature: NA.49.87.H10.10.454.light.4.multim50
ttgggtttgggggctgtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagacctttgagagggcctcagggacccctgagcgattctctggcgtccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaac

SEQ ID NO: 789369 - DNA, 573 bp, Homo sapiens
  misc_feature: NA.47.55.E11.1.454.light.4.multim50
ttgggtttggggagcttcagctgtggtagagaagacaggattcaggacaatctccagcatggccggcttccctctcctcctcaccctcctcactcactgtgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaaggaaatgaccagaggggagtgaatgaggggtgcagagaactccatggctaccaggtcagcccaaggccaaccccactgtcactctgttcccaccctcctctacgtagctcg

SEQ ID NO: 789370 - DNA, 546 bp, Homo sapiens
  misc_feature: NA.51.12.B01.1.454.light.4.multim50
tccgcgggcacgaccggtgctcgatttagtcgagctctctcgcgggcacgaccggtgctcgatttagcgdsgctcgvdagbtccgcgggggtgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcgttccccg

SEQ ID NO: 789371 - DNA, 469 bp, Homo sapiens
  misc_feature: NA.49.35.D02.2.454.light.4.multim50
ttgggtttgggggtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgtttttcggtcggtagggaccaggctgaccgtcctcgggtcagcccaaggctgccccctcggtcacgtcttcgcg

SEQ ID NO: 789372 - DNA, 446 bp, Homo sapiens
  misc_feature: NA.49.35.D02.3.454.light.4.multim50
ttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaaggctcgg

SEQ ID NO: 789373 - DNA, 462 bp, Homo sapiens
  misc_feature: NA.49.35.D02.4.454.light.4.multim50
ttgggtttgggttgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttattactgtcagcagtataattactggctcgttttgggccagggaccgaagctwggagatcaagacgaactwgtggctgcaccatctgtt

SEQ ID NO: 789374 - DNA, 452 bp, Homo sapiens; identical to SEQ ID NO: 788990
  misc_feature: NA.49.35.D02.5.454.light.4.multim50

SEQ ID NO: 789375 - DNA, 452 bp, Homo sapiens
  misc_feature: NA.49.35.D02.6.454.light.4.multim50
tttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccgagggtggaggatcaaaacgdaacg

SEQ ID NO: 789376 - DNA, 479 bp, Homo sapiens
  misc_feature: NA.49.35.D02.7.454.light.4.multim50
ttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctcgccccctcggtcactctcgttcccaccctcct

SEQ ID NO: 789377 - DNA, 477 bp, Homo sapiens
  misc_feature: NA.49.35.D02.8.454.light.4.multim50
tttgggtttgggggctgtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctcgttcccaccctt

SEQ ID NO: 789378 - DNA, 471 bp, Homo sapiens
  misc_feature: NA.48.27.C05.1.454.light.4.multim50
agggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcacttgttttggcggttctccgtactttcggcggagggaccaagggtggaggtcaaacgaactgtggctgcaccatctgtcttct

SEQ ID NO: 789379 - DNA, 492 bp, Homo sapiens
  misc_feature: NA.48.27.C05.2.454.light.4.multim50
agggtttggggagrgytykggrgaagagctgctcagttaggagtttgggggaaccatggaagccccagcgcagcttctcttcctcctgctactctggctcccagaaagcaccggagacattgaactgacgcagtctccaggcaccctgtctttgtctccaggggaaagagccaccctctcctgcagggccggtcggagtctttccagcacctacttagcctggtaccaacaaaaagctggccaggctcccaggctcctcatatatgatgtttctaccagggccactggcattccagacaggttcagtggcagtgggtctgggacagacttcactctcaccatcaacagattggagcctgaagactctgcagtctatttctgtcagcaatatcgcagttcagtctcgtacacttttggccaggggaccacgctggagatcaaacgaactgtggctgcaccatctgtcttcatcttcccgccatctgatatgta

SEQ ID NO: 789380 - DNA, 463 bp, Homo sapiens
  misc_feature: NA.48.27.C05.3.454.light.4.multim50
agggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccgcta

SEQ ID NO: 789381 - DNA, 454 bp, Homo sapiens
  misc_feature: NA.48.27.C05.4.454.light.4.multim50
agggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctcgccccctc

SEQ ID NO: 789382 - DNA, 475 bp, Homo sapiens
  misc_feature: NA.48.27.C05.6.454.light.4.multim50
agggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctggttcggcggagggaccaagctgaccgtcctaagtcagcccaaggctcgccccctcggtcacttctgttycgccctcct

SEQ ID NO: 789383 - DNA, 488 bp, Homo sapiens
  misc_feature: NA.48.27.C05.7.454.light.4.multim50
agggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctcgttcccaccctcctctatgtatact

SEQ ID NO: 789384 - DNA, 464 bp, Homo sapiens
  misc_feature: NA.48.27.C05.8.454.light.4.multim50
agggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgactgtggctgcaccatctgtcttcatcttcccgccat

SEQ ID NO: 789385 - DNA, 451 bp, Homo sapiens
  misc_feature: NA.48.27.C05.9.454.light.4.multim50
agggtttggggggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtcagccccg

SEQ ID NO: 789386 - DNA, 481 bp, Homo sapiens
  misc_feature: NA.48.13.B02.2.454.light.4.multim50
tccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccgaagggacccgggtaggaaagtaaaacgaaactagtggctgcaccatctgtcttcatcttccccg

SEQ ID NO: 789387 - DNA, 474 bp, Homo sapiens
  misc_feature: NA.48.13.B02.4.454.light.4.multim50
tccgcgggggagctacaacaggcaggcaggggcagcaagatggtgttgcagacccaggtcttcatttctctgttgctctggatctctggtgccygcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcgscsggggaccaacgtggaaatcaaacgaactagtggctgcaccatctgtcttcatcttcccg

SEQ ID NO: 789388 - DNA, 468 bp, Homo sapiens
  misc_feature: NA.41.33.C11.4.454.light.4.multim50
ttgggtttggggctgggcctcaggaagcagcatcggaggtgcctcagccatggcgtggatccctctcttcctcggcgtccttgcttcctgcacagtttccgtggcctcctcggaattgactcaggcaccctcagtgtccgtgtctccaggacagacagccagaatcacctgctctggagacacgttgggggagacatttgcttcctggtatcaacagaggccaggccagtcccctatcctggtcatctttcaggatgacaaacggccctctggcatccctgaacgcttctctggttccaggtcaggaaacagagccactctaaccatcaccgagacccaggctgtcgatgaggctgactattactgtcaggcctgggacagaaacactggcatattcggcggagggaccaagctgaccgtcctacgtcacgcccaaggcyygccccctcggtcactctcgttcccgta

SEQ ID NO: 789389 - DNA, 461 bp, Homo sapiens
  misc_feature: NA.48.62.F07.1.454.light.4.multim50
aaggggaaaggggaagggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcaccat

SEQ ID NO: 789390 - DNA, 487 bp, Homo sapiens
  misc_feature: NA.48.62.F07.4.454.light.4.multim50
aagggaaagggggaggttctttctaagggaaaggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtacttttagtttacgtcggaccttcggccaagggacacgactggagattaaacgaactgtggctgcaccatctgtcttcatcttcccgccta

SEQ ID NO: 789391 - DNA, 473 bp, Homo sapiens
  misc_feature: NA.47.83.H06.2.454.light.4.multim50
tcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttccccg

SEQ ID NO: 789392 - DNA, 456 bp, Homo sapiens
  misc_feature: NA.49.61.F06.3.454.light.4.multim50
tgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactcttccgaccctcct

SEQ ID NO: 789393 - DNA, 454 bp, Homo sapiens
  misc_feature: NA.49.61.F06.5.454.light.4.multim50
catgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagactttcggccaagggaccaaggtaggaaatacaaacgaactagtggctgcaccatctcgtcttcatcttcccgccat

SEQ ID NO: 789394 - DNA, 472 bp, Homo sapiens
  misc_feature: NA.52.53.E09.1.454.light.4.multim50
ttgggttttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgctagtttattactgtcagcagcgtagcaactggcctccgatcaccttcggccaagggacacgactggagattaaacgaactgtggctgcaccatctgtcttctattcccg

SEQ ID NO: 789395 - DNA, 495 bp, Homo sapiens
  misc_feature: NA.52.53.E09.3.454.light.4.multim50
ttgggtttgggtttgggggggtaagaaatacctgcaactttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctcgccccccggtcta

SEQ ID NO: 789396 - DNA, 515 bp, Homo sapiens
  misc_feature: NA.40.27.C05.1.454.light.4.multim50
agggtttggagggtttggggcagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctgccccctcggtcactctcgttcccaccctcctcagtcgctcmgtac

SEQ ID NO: 789397 - DNA, 466 bp, Homo sapiens
  misc_feature: NA.40.27.C05.2.454.light.4.multim50
agggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcggcccaaggctcgccccctcggt

SEQ ID NO: 789398 - DNA, 436 bp, Homo sapiens
  misc_feature: NA.49.80.H03.2.454.light.4.multim50
aagggaaagggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgtctcccgctcactttcggtcggggggaccgaaggtggagatcaagcgaactgtgg

SEQ ID NO: 789399 - DNA, 509 bp, Homo sapiens
  misc_feature: NA.40.34.D01.1.454.light.4.multim50
ttgggtttggggagggctggtgggttgggtttggggtggtagctcaggaagcagagcctggagcatctccactatggcctgggctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcagttcccccaccactttaatctatgaggataacaaaagactctctggggtccctgatcggttctctggctccatcgacagctcctccaattctgcctccctcaccatctctggactgaagactgaggacgaggctgattattactgtcagagttatgatgacaccaattactgggtgttcggcggagggaccaagctgaccgtcctaggtcagcccaaggctcgccccctcggtcactctcgttcccgccctt

SEQ ID NO: 789400 - DNA, 459 bp, Homo sapiens
  misc_feature: NA.3.10.A10.2.454.light.4.multim50
agrgggrggaactgctcagttaggacccagacggaaccatggaagccccagcgcagcttctcttcctcctgctactctggctcccagatgccactggagaaatagtgatggcgcagtctccagccaccctgtctgtgtctccaggggaaagagccaccctctcctgcagggccagtcagtctgtttataacaacttagcctggtaccaacagagacctggccaggctcccaggctcctcatgtttggtgcttccaccagggccactggtatcccagccaggttcagtggcagtgggtctgggacagagttcactctcaccatcagcagcctgcagtctgaagattttgcaatttatttctgtcagcagtacaataattggcctttgacgttcggccaagggaccaaggtggaaactaaacgaactgtggctgcaccatctgtcttcatcttcccgccta

SEQ ID NO: 789401 - DNA, 456 bp, Homo sapiens
  misc_feature: NA.48.70.G04.4.454.light.4.multim50
atcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggtccgagaggaccgaacggtggaaagtacaaacgaaacctagtggcgttgcgaccaa

SEQ ID NO: 789402 - DNA, 472 bp, Homo sapiens
  misc_feature: NA.48.70.G04.6.454.light.4.multim50
ctgggcctaaggaagcagcactggtggtgcctcagccatggcctggaccgttctcctcctcggcctcctctctcactgcacaggctctgtgacctcctatgttctgactcagccaccctcggtgtcagtggcccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattggggtgttcgggcggagggaccaagctgaccgtcctaggtcagcccawggctgccccctcggtcactctcgttccctaccct

SEQ ID NO: 789403 - DNA, 493 bp, Homo sapiens
  misc_feature: NA.40.67.G01.2.454.light.4.multim50
ttgggtttgggggaaaaggccctgaggaaaaytrggyttrggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtcctaggtcagcccaaggctgccccctc

SEQ ID NO: 789404 - DNA, 447 bp, Homo sapiens
  misc_feature: NA.40.85.H08.2.454.light.4.multim50
tcgcggggcaaaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagaccccg

SEQ ID NO: 789405 - DNA, 482 bp, Homo sapiens
  misc_feature: NA.51.53.E09.1.454.light.4.multim50
tttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtcactctcgttccccg

SEQ ID NO: 789406 - DNA, 458 bp, Homo sapiens
  misc_feature: NA.51.53.E09.3.454.light.4.multim50
ttgggtttgggggcagaagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcggggggaccgaaggtggagaatcaagacggactgtggctgcaccatctgtt

SEQ ID NO: 789407 - DNA, 463 bp, Homo sapiens
  misc_feature: NA.51.53.E09.6.454.light.4.multim50
ttgggtttgggggaggaactgctcagttaggacccagagggaaccatggaagccccagctcagcttctcttcctcctgctactctggctcccagattccaccggagaaattgtgttgacacagtctccaggcaccctgtctttgtctccaggggaaagagccaccctctcctgcagggccagtcagagtgttagtcacttcttagcctggtaccaacacaaacctggccaggctcccaggctcctcatttatgatgcatccaagagggccactggcgtcccagccaggttcagtggcagtgggtctgggacagacttcactctcaccatcagcagcctagagcctgaagtattttgctaatttattactgtcagcagcgtagcaattggcctccctcgatcaccttcggccaagggacacgactggagaataaacgaactgtggctgcaccatctgtcttcta

SEQ ID NO: 789408 - DNA, 447 bp, Homo sapiens
  misc_feature: NA.49.6.A06.3.454.light.4.multim50
aacacacaaagggggcaggagtcagtcccagtcaggacacagcatggacatgagggtccccgctcagctcctggggctcctgctgctctggctcccaggtgccagatgtgacatccagttgacccagtctccatccttcctgtctgcatctgtcggagacagagtcaccatcacttgccgggccagtcagggcgttagtagttatttagcctggtatcaacaaaaaccagggaaagcccctaacctcctgatatatgctgcaaccactttgcaaagtggggtcccatcaaggttcagcggcagtggatctgggacagagttcactctcactatcagcagcctgcagcctgaagattttgcaacttattattgccatcaagttgatgcttacccgctcactttcggcggagggaccaaggtggagatcagacgaactgtggctgcacc

SEQ ID NO: 789409 - DNA, 466 bp, Homo sapiens
  misc_feature: NA.2.76.G10.1.454.light.4.multim50
aaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtccttggtccg

SEQ ID NO: 789410 - DNA, 454 bp, Homo sapiens
  misc_feature: NA.49.83.H06.2.454.light.4.multim50
tcgcggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactagtggctgcacctatctgtcttcta

SEQ ID NO: 789411 - DNA, 466 bp, Homo sapiens
  misc_feature: NA.51.30.C08.3.454.light.4.multim50
aagggaaaggggtgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggatgttggggtttattactgcgtgcaaagtctgcaaactatcaccttcggccaagggacacgactggagattaaacgaactgtggctgcacctatctgtcttcta

SEQ ID NO: 789412 - DNA, 440 bp, Homo sapiens
  misc_feature: NA.51.30.C08.8.454.light.4.multim50
aagggaaagggggagtcagtcccaaccaggacacagcatggacatgagggtccctgctcagctcctggggctcctgctgctctggctctcaggtggcagatgtatcatccagatgacccagtctccatcctccctgtctgcatatataggagacagaatcaccatcacttgccgggcgagtcaggacattagcgtatatttgaattggtatcagcaaaaaccagggaaagcccctgagctcctgatcctcgatgcatccactttggaaacaggggtcccatcaaggttcagtggaagtggctctgggacacatttttactttcaccatcagcagactgcagcctgaagatgttgcaacatattactgtcaacagtatcataatctcccgctcactttcggcggagggaccaaggtggagatcaaacgaactgtggctgca

SEQ ID NO: 789413 - DNA, 489 bp, Homo sapiens
  misc_feature: NA.48.32.C10.2.454.light.4.multim50
cacgaccggtgctcgatttagtatagacatcaacacacaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggcggagggaccgaaggtggagatcaaacgaactagtggctgcaccatctgttt

SEQ ID NO: 789414 - DNA, 468 bp, Homo sapiens
  misc_feature: NA.48.61.F06.1.454.light.4.multim50
trgtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccaccctcct

SEQ ID NO: 789415 - DNA, 450 bp, Homo sapiens
  misc_feature: NA.48.78.H01.2.454.light.4.multim50
tgggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgccccctccg

SEQ ID NO: 789416 - DNA, 451 bp, Homo sapiens
  misc_feature: NA.48.78.H01.6.454.light.4.multim50
agctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcagcctgcaggctgaggatgtggcagtttattactgtcagcaatattatactactccgtggactttcggccaagggaccaaggtggaaatcagacgaactgtggctgcacatctgtt

SEQ ID NO: 789417 - DNA, 445 bp, Homo sapiens
  misc_feature: NA.48.78.H01.7.454.light.4.multim50
ctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcayataaatatgcttcctggtatcagcagaagccaggccagtcccctgtgctggtcatctatcaacataatcagcggccctcaggtattcctgagcgrttctctggctccagttctgggaacacagccactctgaccatcagcgggacccaggctatggatgaggcgtgactattactgtcaggcggtgggacgatcagcagtggaggtggttttcggtcgggagggaccgaaggcgtggaccgtccgtaagtcagccccaaggtcccg

SEQ ID NO: 789418 - DNA, 438 bp, Homo sapiens
  misc_feature: NA.48.78.H01.8.454.light.4.multim50
tagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccrrtcggttctctggcctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtcagcccg

SEQ ID NO: 789419 - DNA, 470 bp, Homo sapiens
  misc_feature: NA.52.28.C06.2.454.light.4.multim50
actgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcggggtggaggctgaggatgttggggtttattactgcatgcaaggtacacactggcctccgacgttcggccaagggaccaaggtaggaaatacaaacgaaactagtggctgcaccatctgtcttcatattccccg

SEQ ID NO: 789420 - DNA, 445 bp, Homo sapiens
  misc_feature: NA.52.28.C06.3.454.light.4.multim50
tgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtctac

SEQ ID NO: 789421 - DNA, 466 bp, Homo sapiens
  misc_feature: NA.52.28.C06.6.454.light.4.multim50
ctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaattttgggggttttcggcggagggaccaaggtgaccgtcctacgtcagcccaaggctgccccctcggtcactctgtt

SEQ ID NO: 789422 - DNA, 505 bp, Homo sapiens
  misc_feature: NA.40.23.C01.1.454.light.4.multim50
tagggattgggcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcattccccgcc

SEQ ID NO: 789423 - DNA, 475 bp, Homo sapiens
  misc_feature: NA.48.60.F05.3.454.light.4.multim50
gggggggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcatcttcccgcctatctgatatgtatact

SEQ ID NO: 789424 - DNA, 481 bp, Homo sapiens
  misc_feature: NA.48.60.F05.5.454.light.4.multim50
gggaaagggggaagagctgctcagttaggacccagagggaaccatggaaaccccagcgcagcttctcttcctcctgctactctggctcccagataccgccggagaaattttgttgacgcagtctccaggcaccctgtctttgtctccaggggaaagagccaccctctcctgcagggccagtcagtatgttagcagcaactacttagcctggtaccagcagaaacctggccaggctcccaggctcctcatctacggtgcatccagcagggccattggcatcccagacaggttcagtggcagtgggtctgggacaaacttcactctcaccatcagcagactggagcctgaagattttgcagtctattactgtcagcagtatactaactcacctaagacgttcggccaagggaccaaggtggaaatcaaacgaactgtggctgcaccatctgtcttcatcttcccgycatctgatatgtatact

SEQ ID NO: 789425 - DNA, 440 bp, Homo sapiens
  misc_feature: NA.48.60.F05.6.454.light.4.multim50
gggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggagggaccaagsctgactgtacccg

SEQ ID NO: 789426 - DNA, 446 bp, Homo sapiens
  misc_feature: NA.48.60.F05.9.454.light.4.multim50
gggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcaccat

SEQ ID NO: 789427 - DNA, 463 bp, Homo sapiens
  misc_feature: NA.11.57.F02.2.454.light.4.multim50
ttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgckggtgtcccacccaggttcagtggcggtgggtctgggacagtgttcactctcaccatcagcagcctgcagtctgaagattttgcagtttattactgtcagcagtatagtaagtggccgctcactttcggcggagggaccaaggtggagatcagacgaactgtggctgcaccatctgtcttcatcttccccg

SEQ ID NO: 789428 - DNA, 473 bp, Homo sapiens
  misc_feature: NA.48.33.C11.1.454.light.4.multim50
ttgggtttggggtggggagcttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggcctgtccccccg

SEQ ID NO: 789429 - DNA, 462 bp, Homo sapiens
  misc_feature: NA.13.10.A10.1.454.light.4.multim50
agggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgaccgtcctcggtcagcccaaggctgccccatccgt

SEQ ID NO: 789430 - DNA, 467 bp, Homo sapiens
  misc_feature: NA.48.33.C11.6.454.light.4.multim50
ttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatccttcccgccta

SEQ ID NO: 789431 - DNA, 455 bp, Homo sapiens
  misc_feature: NA.48.33.C11.8.454.light.4.multim50
ttgggtttgggggagtcagacccactcaggacacagcatggacatgagggtccccgctcagctcctggggctcctgctgctctgrctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagtattttgcaacttattactgtctgcacgattacaattaccctcggaccgttcggccgaacgggaccgaaggtaggaaggtacaaacgaaactagtggcgtgtcaccta

SEQ ID NO: 789432 - DNA, 449 bp, Homo sapiens
  misc_feature: NA.4.27.C05.2.454.light.4.multim50
agggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggccaggggaccaggctggagatcaaacgaactgtggc

SEQ ID NO: 789433 - DNA, 442 bp, Homo sapiens
  misc_feature: NA.48.37.D04.2.454.light.4.multim50
ttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaasgccg

SEQ ID NO: 789434 - DNA, 454 bp, Homo sapiens
  misc_feature: NA.48.37.D04.4.454.light.4.multim50
ttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccccg

SEQ ID NO: 789435 - DNA, 482 bp, Homo sapiens
  misc_feature: NA.48.37.D04.5.454.light.4.multim50
tttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagctacttgttttggcggttctccgtactttcggcggtagggaccgaaggtgggaggtacgaaacggaacgtgtcggcgtcgcaccatctsktctt

SEQ ID NO: 789436 - DNA, 521 bp, Homo sapiens
  misc_feature: NA.41.14.B03.1.454.light.4.multim50
tccgcgggcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccctcggtctactctcgttcccgccct

SEQ ID NO: 789437 - DNA, 478 bp, Homo sapiens
  misc_feature: NA.52.87.H10.2.454.light.4.multim50
ttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaatttgggggttttcggcggagggaccaaggtgaccgtctacgtcagcccaaggctcgccccctcggtcactctgtt

SEQ ID NO: 789438 - DNA, 458 bp, Homo sapiens
  misc_feature: NA.52.87.H10.5.454.light.4.multim50
ttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactctcg

SEQ ID NO: 789439 - DNA, 458 bp, Homo sapiens
  misc_feature: NA.52.87.H10.7.454.light.4.multim50
ttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtctac

SEQ ID NO: 789440 - DNA, 449 bp, Homo sapiens
  misc_feature: NA.49.30.C08.6.454.light.4.multim50
aagggaaagggcacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccggggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcatcttcccgccatctgat

SEQ ID NO: 789441 - DNA, 464 bp, Homo sapiens
  misc_feature: NA.49.30.C08.8.454.light.4.multim50
aagggaaaggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaaggcccccaaactcttcatttatgatgtcactaatcggccctcaggggtccctgatcgcttctctgcctccaagtctggcaacacggcctccctgaccatctctgggctccaggctgaggatgaggctcattattattgtttgctcatatgcaggcaacttcgcttttgtcttcggaactgggaccgaggtccaccgtcctggggtcacgcccaaggcccaacccc

SEQ ID NO: 789442 - DNA, 463 bp, Homo sapiens; identical to SEQ ID NO: 788729
  misc_feature: NA.48.53.E09.1.454.light.4.multim50

SEQ ID NO: 789443 - DNA, 453 bp, Homo sapiens
  misc_feature: NA.48.53.E09.4.454.light.4.multim50
ttgggtttgggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccgaaggtggagatacaaacgaactgtggctgcaacta

SEQ ID NO: 789444 - DNA, 463 bp, Homo sapiens
  misc_feature: NA.49.30.C08.3.454.light.4.multim50
aagggaaagggggcatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagactttcggccaagggaccaaggtggaaatcaaacgaactgtggctgcaccatctgtcttcatcttcccgccat

SEQ ID NO: 789445 - DNA, 456 bp, Homo sapiens
  misc_feature: NA.51.33.C11.8.454.light.4.multim50
ttgggtttggggagagctgctcagttaggacccagagggaaccatggaaaccccagcgcagcttctcttcctcctgctactctggctcccagatacctccggtgagattgtgttgacgcagtctccaggcaccctgtctttgtttccaggggacagagccaccctctcctgcagggccagtcagagttttagcagcaactacttggcctggtaccagcagaaacctggccaggctcccaggctcctcatctatggtgcatccagcagggccgctggcatcccagacaggttcagtggcagtgggtctgggacagacttcagtctcaccatcagcggactggagcctgaagattttgcagtgtattactgtcagcaccatggtagctcatcccggtacacgttttggccgggggaccaagctggagatcmaaacgaactgtggctgcaccatcttcg

SEQ ID NO: 789446 - DNA, 451 bp, Homo sapiens
  misc_feature: NA.49.41.D08.3.454.light.4.multim50
actgatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactagaaaatcagcagagtggaggctgaggatgttgggatttattactgcatgcaagctctacaagctcctcagctcactttcggcggagggaccaaggtggagatacaaacgaactgtggctgcacc

SEQ ID NO: 789447 - DNA, 450 bp, Homo sapiens
  misc_feature: NA.49.41.D08.5.454.light.4.multim50
catgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagactttcggccaagggaccaaggtggaaatcaaacgaactgtggctgcaccatctgtcttcatcttcccgccat

SEQ ID NO: 789448 - DNA, 460 bp, Homo sapiens
  misc_feature: NA.49.41.D08.7.454.light.4.multim50
ctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggaggggaccaaagctgaccgtcctaggtcagcccaaggctcgcccccgtcggtctactcttccgg

SEQ ID NO: 789449 - DNA, 440 bp, Homo sapiens
  misc_feature: NA.49.41.D08.8.454.light.4.multim50
aagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagtattttgcagtatattactgtcagcatgggagcattcgtgcgctcaccktyggcggagggaccaaggtggagatcaaacgaactgtggctgtcgaccacta

SEQ ID NO: 789450 - DNA, 464 bp, Homo sapiens
  misc_feature: NA.48.28.C06.4.454.light.4.multim50
ctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccrccctcct

SEQ ID NO: 789451 - DNA, 445 bp, Homo sapiens
  misc_feature: NA.48.28.C06.8.454.light.4.multim50
ctacaacaggcaggcaggggcagcaagatggtgttgcagacccaggtcttcatttctctgttgctctggatctctggtgcctacggggacrtcgtgatgamccagtctccagastccctggcwgtgtctctgggcgrgagggccaccatcwactgcaagtccagccagagtmttttwtcacasmwccwayrakaagarckacttagcttggtaccagcagaraccaggacarcctcctaagttgctcwtttactgggcrtctwmccggsartccggggtccctgaccgattcagtgscaggcgggtctgggacasayttcrctytcaccatcagcagcctgcaggctgaggatgtggcagtttattactgtcagcaatattatactactccgtggactttcggccaagggaccaaggtggaaatcagacgaactgtggctgcacc

SEQ ID NO: 789452 - DNA, 439 bp, Homo sapiens
  misc_feature: NA.48.28.C06.10.454.light.4.multim50
tagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctcgtggggtccccgatcggttctctggctccatcgacaggtcctccaactctgcctctctcaccatctctggactgcagactgaggacgaggctgattactactgtcagtcttatgatagtggacaataatggtttggtggtttggcggagggaccaaggctgaccgtcctaggtcaacg

SEQ ID NO: 789453 - DNA, 463 bp, Homo sapiens
  misc_feature: NA.13.55.E11.3.454.light.4.multim50
ttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaagacctacttgaattggtttcagcagaggccaggccagtctccaaggcgcctaatttataatgtttttacccgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtt

SEQ ID NO: 789454 - DNA, 482 bp, Homo sapiens
  misc_feature: NA.13.55.E11.6.454.light.4.multim50
ttkgggtttggggggggtcgacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgywgytcatatrcaagcggmagswstswttatstcttyggargtgggaccaaggtcaccgtcctwrgtcagcccaaggccaaccccactgtcactctgttccccg

SEQ ID NO: 789455 - DNA, 516 bp, Homo sapiens
  misc_feature: NA.43.38.D05.1.454.light.4.multim50
ttgggtttggggtgctcgatttagtatctgatagttgggtttgggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaagggaccagggtggaaatacaaacgaactagtggctgcaccatctgtcttcatcttccccgcctatctgaactactcaca

SEQ ID NO: 789456 - DNA, 465 bp, Homo sapiens
  misc_feature: NA.43.38.D05.3.454.light.4.multim50
tttgggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacactttatgttcttcggaattgggacgacggtcaccgtcctaggtcagcccaaggccaacccctac

SEQ ID NO: 789457 - DNA, 452 bp, Homo sapiens
  misc_feature: NA.40.73.G07.5.454.light.4.multim50
agggcacgaccggtgctcgatttagcagtactgcgttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggctagtttcgcttcgtcgaagttc

SEQ ID NO: 789458 - DNA, 461 bp, Homo sapiens
  misc_feature: NA.40.73.G07.7.454.light.4.multim50
agggcacgaccggtgctcgatttagagtgctacgaagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgaccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcgggcggagggaccaagctacgg

SEQ ID NO: 789459 - DNA, 445 bp, Homo sapiens
  misc_feature: NA.40.73.G07.8.454.light.4.multim50
agggcacgaccggtgctcgatttagagagcgtcacagagagaagggggaagtctctctcagtcaggacacagcatggacatgagggtccctgctcagctcctgggactcctgctgctctggctcccagatactagatgtgacatccagatgacccagtctccaccctccctgtctgcatctgtcggagacaaagtcaccatcacttgccgggcgagtcaagtcattagctaattatttagcctggtatcagcagaaaccagggcaaggtcctaaactcctgatctacgctgcatccactttgcactcgasgggtcccatctcggttcaccggcaggtggatcgtgggacagtatttcactctcatcatcagcagcctgcagcctggaggatgttgctaactttattactgtacaaaagtataaacattcgtcccccttctacccg

SEQ ID NO: 789460 - DNA, 445 bp, Homo sapiens
  misc_feature: NA.49.24.C02.5.454.light.4.multim50
tagggaaagggggagtcagacccagtcaggacacagcatggacatgagggtccccgctcagctcctggggctcctgctgctctggctcccaggtgccaaatgtgacatccagatgacccagtctccttcccttttgtctgcatctgttggagacagagtcaccatcacttgccgggccactgagaacattaatcgctggttggcctggtatcagcagaaaccagggaaagcccctgaggccctcatctatctggcgtctagtttagagagtggggtcccatcaagattcagcggcaatggatctgggacagaattcactctcaccattagcagcctgcagcctgatgatcttgcaacttattactgccaacattataatagttatatgtacatttttggcctagggaccaagttggagaatcaaacgaactagtggctgcacatt

SEQ ID NO: 789461 - DNA, 453 bp, Homo sapiens
  misc_feature: NA.49.24.C02.6.454.light.4.multim50
tagggaaagggggagtcagacccagtcaggacacagcatggacatgagggtccccgctcagctcctggggctcctgctgctctggctcccaggtgccaaatgtgacatccagatgacccagtctccttcccttttgtctgcatctgttggagacagagtcaccatcacttgccgggccactgagaacattaatcgctggttggcctggtatcagcagaaaccagggaaagcccctgaggccctcatctatctggcgtctagtttagagagtggggtcccatcaagattcagcggcaatggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcta

SEQ ID NO: 789462 - DNA, 343 bp, Homo sapiens
  misc_feature: NA.49.24.C02.7.454.light.4.multim50
tagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgaggtcaccgtcctgggtcagcccaaggcccaaccccactgtcactctcgttcccaccctcctctctctcgact

SEQ ID NO: 789463 - DNA, 437 bp, Homo sapiens; identical to SEQ ID NO: 788831
  misc_feature: NA.48.68.G02.1.454.light.4.multim50

SEQ ID NO: 789464 - DNA, 472 bp, Homo sapiens
  misc_feature: NA.48.68.G02.4.454.light.4.multim50
ctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccgccctcctct

SEQ ID NO: 789465 - DNA, 497 bp, Homo sapiens
  misc_feature: NA.40.53.E09.1.454.light.4.multim50
ttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggagggaccaagctgaccgtcckaggtcagcccaaggctgccccctccgg

SEQ ID NO: 789466 - DNA, 453 bp, Homo sapiens
  misc_feature: NA.40.53.E09.4.454.light.4.multim50
ttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccggactgttctatacagcttcaacaataagaactctgtggcttggtaccagcacaaaccaggacagcctcccaagctgctcattgactgggcatctacccggggatccggggtccctgaccgattcagtggcagcgggtctgggacagatttcactctsaccatcascagcctgcaggctgaagatgtggcrgtttattactgtcaacaatattmtgrtyawtcysagkwckttcggcsragggaccaagggtggaratcaracgaactgtgg

SEQ ID NO: 789467 - DNA, 484 bp, Homo sapiens
  misc_feature: NA.48.77.G11.1.454.light.4.multim50
aagggaaagggggaggttctttctaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtacttttagtttacgtcggaccttcggccaagggacacgactggagattaaacgaactgtggctgcaccatctgtcttcatctccccg

SEQ ID NO: 789468 - DNA, 461 bp, Homo sapiens
  misc_feature: NA.48.77.G11.5.454.light.4.multim50
aagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccgacgtgdaatacmaacgaactgtggctgcaccata

SEQ ID NO: 789469 - DNA, 483 bp, Homo sapiens
  misc_feature: NA.41.35.D02.2.454.light.4.multim50
tttgggtttggggggggtctcaggaggcagcgctctcgaggacgtcaccaccatggcctgggctctgctcctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctcgccccctcggtcactctcgttcccg

SEQ ID NO: 789470 - DNA, 459 bp, Homo sapiens
  misc_feature: NA.48.77.G11.2.454.light.4.multim50
aagggaaaggggagagctctggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcaccat

SEQ ID NO: 789471 - DNA, 439 bp, Homo sapiens
  misc_feature: NA.49.57.F02.3.454.light.4.multim50
ttgggtttggggbyaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggtcgggggaccgaacgtggagatcaagcgaactgtgg

SEQ ID NO: 789472 - DNA, 472 bp, Homo sapiens
  misc_feature: NA.49.62.F07.2.454.light.4.multim50
aagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcacactttcggccggagggaccaagggtggagatcaaacgaactgtggctgcaccatctgtcttctatcttcccgcacta

SEQ ID NO: 789473 - DNA, 450 bp, Homo sapiens
  misc_feature: NA.51.29.C07.3.454.light.4.multim50
agggaaaggggagtcccaaccaggacacagcatggacatgagggtccctactcagctcctggggctcctgctgctctggctctcaggtgccagatgtgacatccagatgacccagtctccgtcctccctgtctgcgtctgtaggagacagagtcaccatcacttgccaggcgagtcaggacattagcaacaatttgatctggtatcagcagaaacctggcagagcccctagtctcatgatctatgatgcatctattttggaagacggggtcccatcccggttcagtgggagtggatctgggacaaatttttctttcaccatcaccaacctgcaacctgaggattttgcaacatatttctgtcaacaatatgataatgtccccaccgtcactttcggcggagggaccaaggtggacctcaaacgaactgtggctgcaccatctgtcttcta

SEQ ID NO: 789474 - DNA, 444 bp, Homo sapiens
  misc_feature: NA.51.29.C07.4.454.light.4.multim50
agggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgtacttttactgtcaggcgtgggacagcgacactgtcgtgttcggcggagggaccaagctcgaccgtcctcggtcagcccaaggctcccg

SEQ ID NO: 789475 - DNA, 465 bp, Homo sapiens
  misc_feature: NA.40.42.D09.1.454.light.4.multim50
aagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtcctaggtcagcccaaggctgccccctcggtcactctcg

SEQ ID NO: 789476 - DNA, 472 bp, Homo sapiens
  misc_feature: NA.48.34.D01.4.454.light.4.multim50
tttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggtttctccgactttcggcggagggaccgaaggtggaggtacgaacgaactagtggctgcaccatctgtctt

SEQ ID NO: 789477 - DNA, 461 bp, Homo sapiens
  misc_feature: NA.48.34.D01.7.454.light.4.multim50
ttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagccaggctckccsctc

SEQ ID NO: 789478 - DNA, 486 bp, Homo sapiens
  misc_feature: NA.48.34.D01.8.454.light.4.multim50
ttgggtttgggggctggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgatgtcactaagcggccctcgggggtccctgatcgcttctctggctccaagtctggcaacacggcctccctgaccatctctgggctccaggctgaagatcaggctgattattactgctgttcattttcaagtttccttttttgtcttcggaacttgggaccgaggtcaccgtcctaggtcagcccaaggccaaccccactgtcactctgttccctacctcct

SEQ ID NO: 789479 - DNA, 465 bp, Homo sapiens
  misc_feature: NA.49.34.D01.1.454.light.4.multim50
ttgggtttgggtgtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgttgttttcggcggagggaccaggctgaccgtcctgggtcagcccaaggctgccccctcggtccactcttccg

SEQ ID NO: 789480 - DNA, 481 bp, Homo sapiens
  misc_feature: NA.49.34.D01.6.454.light.4.multim50
ttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctcgccccctcggtcactctcgttcccg

SEQ ID NO: 789481 - DNA, 492 bp, Homo sapiens
  misc_feature: NA.43.37.D04.3.454.light.4.multim50
ttgggtttggggctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctcctcccccctactaactttcggtcaggggaccaagttgaacatcwaatcgaaactgtcggctggcacctatcttcg

SEQ ID NO: 789482 - DNA, 540 bp, Homo sapiens
  misc_feature: NA.51.38.D05.1.454.light.4.multim50
ttgggtttgggcacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcactctcgttcccaccctcctctcgtagcact

SEQ ID NO: 789483 - DNA, 466 bp, Homo sapiens
  misc_feature: NA.49.78.H01.7.454.light.4.multim50
agtgctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctgccccctcggtcactctsyk

SEQ ID NO: 789484 - DNA, 456 bp, Homo sapiens
  misc_feature: NA.40.35.D02.6.454.light.4.multim50
ttgggtttgggggcaggagtcagacccactcaggacacagcatggacatgagggtccccgctcagctcctggggctcctgctgctctggctcccaggtgccagatgtgccatccagatgacccagtctccatcctccctgtctgtatctgtaggagacaaagtcaccatcacttgccgggcaagtcaggacattagaaatgaattagcctggtttcagcagaaaccagggaaagcccctaagctcctgatctatgctgcatccactttagaaaatggggtcccatcaagattcagcggcagtggatctggcacagatttcactctcaccgtcagcagcctgcagtctgaagattttgctaacttattaactgtctacaagattataattaccctcggacgttcggtccasgggtaccgaacggtacggaagtgtctaagcggaactagtgsstgca

SEQ ID NO: 789485 - DNA, 478 bp, Homo sapiens
  misc_feature: NA.49.38.D05.1.454.light.4.multim50
ttgggtttgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 789486 - DNA, 444 bp, Homo sapiens
  misc_feature: NA.49.38.D05.7.454.light.4.multim50
ttgggtttgggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgctaacttattattgtacaacagagttacagtatcccgtactacttttggcccaggggaccaggctggatatcagacgaacctggtggctcg

SEQ ID NO: 789487 - DNA, 484 bp, Homo sapiens
  misc_feature: NA.13.37.D04.3.454.light.4.multim50
ttgggtttggggctggccctcagtaagcagcatcggaggtgcctcagccatggcatggatccctctcttcctcggcgtcctggcttactgctcagcctccatggcctcctataaggtgacccaggcaccctcagtgtccgtgcccccaggacagacagccatcatcacctgctctggagataaattgggggagaaatttgcttcctggtatcagaagaagccaggccagtcccctgtggtggtcatttatcaagataccaaacggccctcagggatccctgagcgattctctggttccaactctgggaatacagccactctgaccatcaacgggactcaggctatggatgaggctgactattactgtcaggtgtgggacagcaacacctatgtggtattcggcggagggaccaagctgaccgtcctaggtcagcccaaggctgccccctcggtcactctgttcccgccctcctctagtacgtga

SEQ ID NO: 789488 - DNA, 464 bp, Homo sapiens
  misc_feature: NA.48.42.D09.6.454.light.4.multim50
agggaaagggrkwgrgragagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactcggaccctgaagattttgcagtgttattactgtcagcagtagtggtagctcaccgatcaccttcggccaagggacacgactggagattaaccgaactgtggctgcaccatctgtcttcta

SEQ ID NO: 789489 - DNA, 471 bp, Homo sapiens
  misc_feature: NA.51.35.D02.1.454.light.4.multim50
ttgggtttggggttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcs

SEQ ID NO: 789490 - DNA, 456 bp, Homo sapiens
  misc_feature: NA.51.87.H10.3.454.light.4.multim50
ttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactcc

SEQ ID NO: 789491 - DNA, 469 bp, Homo sapiens
  misc_feature: NA.43.30.C08.2.454.light.4.multim50
aagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacartttmrtwactactcckcysactttcggtmsgagggaccgassgtcggaratacaaacgaactagtggctgcaccatctgtcttctactcttccccg

SEQ ID NO: 789492 - DNA, 481 bp, Homo sapiens
  misc_feature: NA.52.33.C11.5.454.light.4.multim50
ttkgggtttggggctggscstcaggaagcagcatcgggggtgccgcagccatggcctggaccgctctccttctgagcctccttgctcactttacagggtctgcggcctcccatgacctgactcagtcactctcagtgtcggtggccctggggacagacggccactattacctgtgggggatacaacattggaactaaaaatgtgcagtggtaccagcagaagccaggccaggcccctgtgttggtcatctatagggatcgaagacgggcctctgggattcctgagcgattctctggctccaactcggagaacacggccaccctgaccatcagaagtgcccaaagtcggtgatgaggcagactattactgccaggtgtgggacagtggtgttgtgatattcggcggagggaccaagctgaccgtcctaagtcagcccaaggctgccccctcggtccactctgttcccaccctcctctatacg

SEQ ID NO: 789493 - DNA, 439 bp, Homo sapiens
  misc_feature: NA.51.41.D08.2.454.light.4.multim50
ctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctcgaccgtcctcggtcagcccaaggctcgccgcctccg

SEQ ID NO: 789494 - DNA, 454 bp, Homo sapiens
  misc_feature: NA.41.57.F02.1.454.light.4.multim50
gttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcacggccaacg

SEQ ID NO: 789495 - DNA, 482 bp, Homo sapiens
  misc_feature: NA.48.9.A09.5.454.light.4.multim50
agggcacgaaccggtgctcgatttagctctacgctcagggcacgaccggtgctcgatttagakcgtcaygtrttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcgaggga

SEQ ID NO: 789496 - DNA, 480 bp, Homo sapiens
  misc_feature: NA.51.57.F02.3.454.light.4.multim50
ttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataaycgacagggtggaggctgaggatgttgggttttattactgcatgcaaggtacacactggcctggggacgttcggccaagggaccgaaggtggaaatacaaacgaactgtggctgcaccatctgtcttctactcttccccg

SEQ ID NO: 789497 - DNA, 465 bp, Homo sapiens
  misc_feature: NA.51.57.F02.8.454.light.4.multim50
ttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgtattttcggcggagggaccagtctgaccgtcctaggtcagcccaaggctcgccccctcggtcactctgttcccc

SEQ ID NO: 789498 - DNA, 452 bp, Homo sapiens
  misc_feature: NA.48.55.E11.1.454.light.4.multim50
ttgggtttggggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggtccaagggaccaaggtaggaagtacaaacgaaactacgtggctgcacctact

SEQ ID NO: 789499 - DNA, 500 bp, Homo sapiens
  misc_feature: NA.48.55.E11.9.454.light.4.multim50
ttgggtttgggggtgctcgatttagatcgtctgtgttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctcgccccctcggtcactcttccg

SEQ ID NO: 789500 - DNA, 432 bp, Homo sapiens
  misc_feature: NA.52.72.G06.1.454.light.4.multim50
agtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcggcgggggaccgaaggtggagatcaaacgaactgtggctgcaccmtcg

SEQ ID NO: 789501 - DNA, 465 bp, Homo sapiens
  misc_feature: NA.40.55.E11.3.454.light.4.multim50
ttgggtttgggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 789502 - DNA, 465 bp, Homo sapiens
  misc_feature: NA.48.80.H03.6.454.light.4.multim50
aagggaaagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccgaagggacacgactggagattaaccgaactagtggcgtgcaccactctgtcttcaytcc

SEQ ID NO: 789503 - DNA, 463 bp, Homo sapiens
  misc_feature: NA.41.37.D04.5.454.light.4.multim50
ttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggt

SEQ ID NO: 789504 - DNA, 452 bp, Homo sapiens
  misc_feature: NA.41.12.B01.4.454.light.4.multim50
tccgcggggaggaatcagacccagtcaggacacagcatggacatgagagtcctcgctcagctcctggggctcctgctgctctgtttcccaggtgccagatgtgacatccagatgacccagtctccgtcctcactgtctgcatctgtgggagacagagtcaccatcacttgtcgggcgagtcaggacattagcaattatttagcctggtttcagcagaaacccggcaacgcccctaaatccctaatctatgctgcatccactttgcgaagtggggtcccgtcaaagttcagcggcggcagatctgggacagacttcactctcaccatcagcaacctgcagcctgaagattttgcaacttattactgccaacaatacagcacgtttcccctcactttcggcggagggaccagggtggagatcaaacgaactgtggctgcaccatctgtcttcta

SEQ ID NO: 789505 - DNA, 440 bp, Homo sapiens
  misc_feature: NA.41.12.B01.6.454.light.4.multim50
tccgcgggcacgaccggtgctcgatttagtacagatcgttagggaaaggggctgggcctcaggaagcagcatcggaggtgcctcagccatggcatggatccctctcttcctcggcgtccttgcttactgcacaggatctgtggcctcctttgagctgactcagccaccctcagtgtccgtgtccccaggacagacagccagcatcacctgctctggagataaattggggaataaatatgcttcctggtatcagcagaagccaggccagtcccctgtgctggtcatctatcaaagttcccagcggccctcagggatccctgagcgattctctggctccaattctgggaacacagccactctgaccatcagcgggacccaggctatcgatgaggctgagtattactgttcaggcgtgggacatcagcactgaggtggtattc

SEQ ID NO: 789506 - DNA, 469 bp, Homo sapiens
  misc_feature: NA.48.35.D02.1.454.light.4.multim50
ttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctcgccccctcggtccactctcgtt

SEQ ID NO: 789507 - DNA, 474 bp, Homo sapiens
  misc_feature: NA.48.35.D02.7.454.light.4.multim50
ttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccgccct

SEQ ID NO: 789508 - DNA, 440 bp, Homo sapiens
  misc_feature: NA.48.35.D02.9.454.light.4.multim50
ttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatccagcgggacccaggctatggatgaggctgactattactgtcaggcgtgggacatcagcagtgaggtggktttcggcggagggaccaagctgaccgtcctaagtcagaccccg

SEQ ID NO: 789509 - DNA, 468 bp, Homo sapiens
  misc_feature: NA.52.27.C05.2.454.light.4.multim50
agggtttgggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaatttactactgtcaacagagtgacaatacccctcagactttcggccctgggaccagagtggatatcaaacgaactgtggctgcaccatctgtcttctattcccgccatctgata

SEQ ID NO: 789510 - DNA, 475 bp, Homo sapiens
  misc_feature: NA.52.27.C05.4.454.light.4.multim50
agggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatcttccccgccatctgata

SEQ ID NO: 789511 - DNA, 432 bp, Homo sapiens
  misc_feature: NA.52.27.C05.7.454.light.4.multim50
agggtttggggctgggcctcaggaagcagcatcggaggtgcctcagccatggcatggatccctctcttcctcggcgtccttgcttactgcayaggatccgtggcctcctatgagctgactcagccacactcagtgtccgtgtccccaggacagacagccagcatcacctgctctggagatgaattggggaataaatttgcttgctggtatcaccagaagccaggccagtcccctgtcctggtcatctatcaagatgtcaagcggccctcagggatccctgagcgattctctggctccaactctgggaacacagccactctgaccatcagcgggacccaggctatggatgaggctgactattactgtcaggcgtgggacagcaacactgtggtattcggcggagggaccaagctgaccgtcctaggtcagccc

SEQ ID NO: 789512 - DNA, 506 bp, Homo sapiens
  misc_feature: NA.43.27.C05.1.454.light.4.multim50
agggtttggggagcttcagggtttgggtagagaagacaggattcaggacaatctccagcatggccggcttccctctcctcctcaccctcctcactcactgtgcagggtcctgggcccagtctgtactgactcagccaccctcagcgtctgggacccccgggcagagggtcaccatctcttgttctgggacctactccaacatcggaagtaattatgtttactggtaccagcagctcccaggaacggcccccaaactcctcatctataggaataatcagcggccctcaggggtccctgaccgattctctggctccaagtctggcacctcagcctccctggccatccgtgggctccggtccgaggatgaggctgattattactgtgcaacatgggatgacaccctgagtgcctatgtggttttcggcggagggaccaagctgaccgtccaaggtcagcccaaggctgccccctcggtcactctgttcccrccctcctcactactcaca

SEQ ID NO: 789513 - DNA, 505 bp, Homo sapiens
  misc_feature: NA.43.55.E11.2.454.light.4.multim50
ttgggtttgggcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtaggaaatacaaacgaactagtggctgcaccatctgtcttcacttcccgt

SEQ ID NO: 789514 - DNA, 426 bp, Homo sapiens
  misc_feature: NA.48.23.C01.4.454.light.4.multim50
tagggattgggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 789515 - DNA, 472 bp, Homo sapiens
  misc_feature: NA.49.72.G06.3.454.light.4.multim50
agaagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggagatcaaacgaactgtggctgcaccatctgtcttcatcttcccgccatctgatctctcgact

SEQ ID NO: 789516 - DNA, 440 bp, Homo sapiens
  misc_feature: NA.49.72.G06.5.454.light.4.multim50
ctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaaggcccccaaactcttcatttatgatgtcactaatcggccctcaggggtccctgatcgcttctctgcctccaagtctggcaacacggcctccctgaccatctctgggctccaggctgaggatgaggctcattattattgttgctcatatgcaggcaacttcgcttttgtcttcggaactgggaccgaggtcaccgtcctgggtcagcccaagg

SEQ ID NO: 789517 - DNA, 476 bp, Homo sapiens
  misc_feature: NA.51.37.D04.2.454.light.4.multim50
ttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggraccagcrgtgacrttggtgtgttataaytatgtctcctggtaccarcaccacccaggcaaagcccccaaactcatgatttatgatgtcagtgatcggccctcaggggtttcgaatcgcttctctggctccaagtccggcaacacggcctccctgaccatctctggsctccaggccgaggacgaggctgattattactgcasctcatatacaagcaryaacaattgggtgttcggcgggagggaccaagctgaccgtcctaggtcagcccaaggctgccccctcggtccactctccg

SEQ ID NO: 789518 - DNA, 462 bp, Homo sapiens
  misc_feature: NA.51.37.D04.9.454.light.4.multim50
ttgggtttgggggaggaactgctcagttaggacccagagggaaccatggaagccccagctcagcttctcttcctcctgctactctggctcccagattccaccggagaaattgtgttgacacagtctccaggcaccctgtctttgtctccaggggaaagagccaccctctcctgcagggccagtcagagtgttagtcacttcttagcctggtaccarcasaaacctggccaggctcccaggctcctcatytatgatgcatccamragggccactgryrtcccagccaggttcagtggcagtgggtctgggacagasttcactctcaccatcagcagcctrsagyctgaagattttgcaatttattactgtcagcagyrtaryaaytggcctccstcgatcacyttyggccagggacacragctggagatmwaacgaactgtggctgcaccatcctgtcttcta

SEQ ID NO: 789519 - DNA, 342 bp, Homo sapiens; identical to SEQ ID NO: 787837
  misc_feature: NA.41.34.D01.2.454.light.4.multim50

SEQ ID NO: 789520 - DNA, 474 bp, Homo sapiens
  misc_feature: NA.49.23.C01.1.454.light.4.multim50
tagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttcccacccttct

SEQ ID NO: 789521 - DNA, 458 bp, Homo sapiens
  misc_feature: NA.49.23.C01.3.454.light.4.multim50
tagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagtattttgctagtttattactgtcagcagtataatgaccgggctccggacctttcggccgasgggacccaaggtggagatcaaacgaactgtggctgcaccatctgtctt

SEQ ID NO: 789522 - DNA, 451 bp, Homo sapiens; identical to SEQ ID NO: 789011
  misc_feature: NA.49.53.E09.3.454.light.4.multim50

SEQ ID NO: 789523 - DNA, 448 bp, Homo sapiens
  misc_feature: NA.48.73.G07.5.454.light.4.multim50
agggcacgaccggtgctcgatttagavtcagvtagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggacc

SEQ ID NO: 789524 - DNA, 436 bp, Homo sapiens
  misc_feature: NA.48.73.G07.7.454.light.4.multim50
agggcacgaccggtgctcgatttagyagtactgatmgttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagycccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagyagtgaggtggttttc

SEQ ID NO: 789525 - DNA, 500 bp, Homo sapiens
  misc_feature: NA.48.73.G07.10.454.light.4.multim50
agggcacgaccggtgctcgatttagtgtcgtcgcaagagagrgsrsgasmgstgctcgakttagtgwcgtcgcaagagagagggraccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaagggtggaaatcaaacgaactgtggctgcaccatctgtcttc

SEQ ID NO: 789526 - DNA, 449 bp, Homo sapiens
  misc_feature: NA.48.73.G07.11.454.light.4.multim50
agggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggaccgacgggtggaaagtacaaacgaactagtggctgcaccatctgtctt

SEQ ID NO: 789527 - DNA, 460 bp, Homo sapiens
  misc_feature: NA.49.9.A09.4.454.light.4.multim50
agggcacgaccggtgctcgatttagadckhcbgtagttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctrg

SEQ ID NO: 789528 - DNA, 497 bp, Homo sapiens
  misc_feature: NA.49.9.A09.5.454.light.4.multim50
agggcacgaccggtgctcgatttagctctacgctcagggcacgaccggtgctcgatttagatcgtctgtgttgggtttgggggtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgttttcggtcggagggaccaggctgaccgtccg

SEQ ID NO: 789529 - DNA, 508 bp, Homo sapiens
  misc_feature: NA.49.15.B04.4.454.light.4.multim50
tccgcgggcacgaccggtgctcgatttagctctackcysmgggcacgaccggtgctcgatttagtcwsrcgwsaaagggaaagggggaggaactgctcagttaggacccagagggaaccatggaagccccagctcagcttctcttcctcctgcttctctggctcccagatattaccggagaaattgtgttgacgcagtctccagccaccctgtctttgtctccaggggaaagagccaccctctcctgcagggccagtcagagtgttaacatctacttagtctggtaccaacagaaagctggccacgctcccaggctcctcatctatgatacatccaccacgggcccctggcatcccagccaggttcagtggcagtgggtctgggacagacttcactctcaccatcagcagcttagagcctgaagtattttgctagtttattacttgtcagcagcgtatcaccgggtatccaccttcggccaacgggacccgactggagattaagcgaa

SEQ ID NO: 789530 - DNA, 463 bp, Homo sapiens
  misc_feature: NA.49.15.B04.8.454.light.4.multim50
tccgcgggcacgaccggtgctcgatttagtaghatavtrttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggcckaggggaccaagcta

SEQ ID NO: 789531 - DNA, 447 bp, Homo sapiens
  misc_feature: NA.52.35.D02.5.454.light.4.multim50
ttgggtttgggggaagagctgctcagttaggacccagagggaaccatggaaaccccagcgcagcttctcttcctcctgctactctggctcccagatatcaccggagaaattgtgttgacgcagtctccaggcaccctgtctctgtctccaggggagagagccaccctctcctgcaggaccagtcagagtattagcaacagttacttagcctggtaccagcagaatcctggccaggctcccaggctcctcatctatggtgcgtccagcagggccactggcatcccagacaggttcagtggcagtgggtctgggacagacttcactctcaccatcagcagggtggagcctgaggattttgcagtgtattattgtcagcactatggtaggtcacagtacacttttggccaggggaccaagctggagatcaaacgaactgtggctgcacca

SEQ ID NO: 789532 - DNA, 450 bp, Homo sapiens
  misc_feature: NA.48.58.F03.2.454.light.4.multim50
aagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgstwatmmctatgtctcctggtaccaacarcacscwggcaaagcccccaaactcatgatttatgatrtcactaagcggccctcaggggtccctgmtcgcttctctggctccmagtctggcaacacggcctccctgaccatctctgggctccaggctgargatgaggctgattattwctgctgctcatatgcaggcagcyacactttkrtgttcgktcggaactgacgaaccgtaaggtccaccgtcctac

SEQ ID NO: 789533 - DNA, 469 bp, Homo sapiens
  misc_feature: NA.48.58.F03.8.454.light.4.multim50
aagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactagaaaatcagcagagtggaggctgaggatggttggggtttattactgcatgcaagctctacaaactcctcggggcgttcggccrwrggaccgaacggtaggaaacgtacgaaacgaacgtagtaggcgtgtcga

SEQ ID NO: 789534 - DNA, 451 bp, Homo sapiens
  misc_feature: NA.48.29.C07.5.454.light.4.multim50
aagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggagggaccaaggtsacygtccaggtcagaccccg

SEQ ID NO: 789535 - DNA, 462 bp, Homo sapiens
  misc_feature: NA.52.75.G09.1.454.light.4.multim50
aggaggggggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgacattggtcgttataactatgtctcctggtaccgacaacaccccggcaaagcccccaaactcatgatttatgctgtcacttatcggcccgcagggatttctcatcgcttctctggctccaagtctggcaacacggcctccctcaccatctctgggctcctgactgaggacgaggctgattattactgcagctcatttacaagcaccaccactcctgtaatcttcggcggagggaccaagctgaccgtcctaggtcagcccaaggctgccccctcggt

SEQ ID NO: 789536 - DNA, 452 bp, Homo sapiens
  misc_feature: NA.52.59.F04.1.454.light.4.multim50
tagggattgggggcagaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcagtgggtctgggacagattttactctcaccatcagcagcctgcagcctgaagatgttgcaacttatttctgtcataactatgatgatgcccctcacacgttcggccaagggaccaagctggaaatcaaacgaactgtggctgcaccatctgtt

SEQ ID NO: 789537 - DNA, 445 bp, Homo sapiens
  misc_feature: NA.49.37.D04.5.454.light.4.multim50
ttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcaggacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcagsctgcagcctgaagatattgcaacatattactgtcaacagtatgatagtctcccgctcactttcggcggggggaccgaaggtggagatacaagacgaactgtggctgcacca

SEQ ID NO: 789538 - DNA, 466 bp, Homo sapiens
  misc_feature: NA.41.21.B10.2.454.light.4.multim50
agagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaattaaacgaactgtggctgcaccatctgtcttcatcttcccgcctacg

SEQ ID NO: 789539 - DNA, 471 bp, Homo sapiens
  misc_feature: NA.48.81.H04.1.454.light.4.multim50
actgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaagtaaaacgaactagtggctgcaccatctgtcttcatcttccccg

SEQ ID NO: 789540 - DNA, 461 bp, Homo sapiens
  misc_feature: NA.26.12.B01.2.454.light.4.multim50
tccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcacttcggcggagggaccaggggtggagagtcagacgaacgtagtggtcgtcgtcgaccact

SEQ ID NO: 789541 - DNA, 485 bp, Homo sapiens
  misc_feature: NA.52.55.E11.5.454.light.4.multim50
ttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaacgcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaactaakttkggggttttcggcggrrggaccaaggtgaccgtcctacgtcacgcccaaggctcgccccctcggtcactctcgttccccg

SEQ ID NO: 789542 - DNA, 449 bp, Homo sapiens
  misc_feature: NA.49.54.E10.1.454.light.4.multim50
aacacacaaagggggagagctgctcagttaggacccagagggaaccatggaaaccccagcgcagcttctcttcctcctgctactctggctcccagatgtcaccggagaaattgtgttgacgcagtctccaggcaccgtgtctttgtctccgggggaaagagtctccctctcctgcagggccagtcagagtcttggcagcagcaagttagcctggtatcagcagaaacctggccagcctccccggctcctcatctctgatgcaaccagcagggcctctggcatcccagacaggttcagtggcagtgagtctggcgcagacttcactctcaccatcagcagactggagcctgaagattttgcagtgtattactgtcagcagtatggtacttctattcgtgtacttttggccgaggggaccaagctgcaaatacaaacgaactgtggctgca

SEQ ID NO: 789543 - DNA, 517 bp, Homo sapiens
  misc_feature: NA.49.55.E11.4.454.light.4.multim50
ttgggtttgggggtgctcgatttagtctagcgactttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgacgtactattgttactcaccagacaccagtagaaaatcacagaggaatattcggcggagggaccaagctgaccgtcctaggtcagcccaaggctcgccccctcggtcactctcgttcccaccctcct

SEQ ID NO: 789544 - DNA, 460 bp, Homo sapiens
  misc_feature: NA.40.38.D05.3.454.light.4.multim50
ttgggtttggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtgttcggcggggggaccaaggctgaccgtcctaagtcagcccaac

SEQ ID NO: 789545 - DNA, 450 bp, Homo sapiens
  misc_feature: NA.40.38.D05.5.454.light.4.multim50
ttgggtttggggragagctgctcagttaggacccagagggaaccatggaaaccccagcgcagcttctcttcctcctgctactctggctcccagatagcaccggagaaatcgtgttgacgcagtctccaggcaccctgtctgtgtctccaggggaaagagccaccctctcctgcagggccagtcagagtgttagcagcagctacttagcctggtaccagcataaaccgggccaggctcccaggctcctcatctatggtgcatccagcagggccactggcatcccagacaggttcagttgcagtgggtctgggacagacttcactctcaccatcagcagactggagcctgaagattttgcaatttattactgtcagcagtatggtacctcacccaggtacacttttggccgaggggaccaagttggagatacaaacgaactgtggctgcacc

SEQ ID NO: 789546 - DNA, 494 bp, Homo sapiens
  misc_feature: NA.40.87.H10.1.454.light.4.multim50
ttgggtttggggagcttcagcttggtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggagggaccaagctgaccgtcctaggtcagcccaaggctgccccctcggtcactctgttcccaccctcctc

SEQ ID NO: 789547 - DNA, 416 bp, Homo sapiens
  misc_feature: NA.48.12.B01.4.454.light.4.multim50
tccgcggggaccctcagactgagccaacggccttttctggcctgatcacctgggcatgggctgctgagagcagaaaggggaggcagattgtctctgcagctgcaagcccagcacccgccccagctgctttgcatgtccctcccagccgccctgcagtccagagcccatatcaatgcctgggtcagagctctggagaagagctgctcagttaggacccagagggaaccatggaaaccccagcgcagcttctcttcctcctgctactctggctcccagatactaccggagaagttcttttctgtcagcagtatggtggctcacccgcgtacagttttggccaggggaccaagctggagatcaagcgaactgtggctgcaccatctgtcttcatcttcccgccatctgatatgtatact

SEQ ID NO: 789548 - DNA, 525 bp, Homo sapiens
  misc_feature: NA.48.12.B01.5.454.light.4.multim50
tccgcgggcacgaccggtgctcgatttagtagtgtagatccgcgggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtaaccatctcctgctctggaagtagttccaacattgggaataattatgtctcctggtatcagcaactcccaggaacagcccccaaactcctcatttatgacaataataagcgaccctcaggaattcctgaccgattctctggctccaagtctggcacgtcagccaccctgggcatcaccggactccagactggggacgaggccgattattactgcggaacatgggataacagcccgagtggtggccgggtcttcggcggagggaccaaaggctagacccgtccttaccgtcgacgccccgaaaggctcgtcccccccg

SEQ ID NO: 789549 - DNA, 443 bp, Homo sapiens
  misc_feature: NA.48.12.B01.7.454.light.4.multim50
tccgcgggcacgaccggtgctcgatttagmwcgwckrtagttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtcccccgatcggttctctggctccatcgacaggtcctccaactctgcctctctcaccatctctggactgcagactgaggacgaggctgattactactgtcagtcttatgatagtggcaatt

SEQ ID NO: 789550 - DNA, 452 bp, Homo sapiens
  misc_feature: NA.49.60.F05.6.454.light.4.multim50
gggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccggggaaggcccctaggttactgatctatgctgcagccaatttgcaaagtggggtcccatcaaggttcagtggcagtggatctgggacagaattcactctcaccatcagcagtctgcaacctgaagattttaggaaagtactattgtcaacagagttacggaaacttgctcattttcggcggagggaccaaggtggagatcaaacgaactgtggctgcaccatctgtcttcta

SEQ ID NO: 789551 - DNA, 466 bp, Homo sapiens
  misc_feature: NA.49.29.C07.2.454.light.4.multim50
agggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctccgccctcct

SEQ ID NO: 789552 - DNA, 463 bp, Homo sapiens
  misc_feature: NA.49.29.C07.7.454.light.4.multim50
agggaaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactcttccg

SEQ ID NO: 789553 - DNA, 432 bp, Homo sapiens
  misc_feature: NA.49.29.C07.8.454.light.4.multim50
agggaaagggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagatttttactttcaccatcagcaggctgcagcctgaagatattgcaacattattactgtcaacagtatgatcmgtcttcccgctcactttcggacgggggaccrarggtggagatcaagcgaa

SEQ ID NO: 789554 - DNA, 434 bp, Homo sapiens
  misc_feature: NA.48.25.C03.3.454.light.4.multim50
ctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggkcggagggaccaagmctgaccgtcctaagtccagcccaasgccg

SEQ ID NO: 789555 - DNA, 451 bp, Homo sapiens
  misc_feature: NA.52.38.D05.3.454.light.4.multim50
ttgggtttgggggagctgctcagttaggacccagagggaaccatggaaaccccagcgcagcttctcttcctcctgctactctggctcccagatatcaccggagaaattgtgttgacgcagtctccaggcaccctgtctctgtctccaggggagagagccaccctctcctgcaggaccagtcagagtattagcaacagttacttagcctggtaccagcagaatcctggccaggctcccaggctcctcatctatggtgcgtccagcagggccactggcatcccagacaggttcagtggcagtgggtctgggacagacttcactctcaccatcagcagggtggagcctgaggattttgcagtgtattattgtcagcactagtggtaggtcacagtactacttttggccgaaggggaccaagcgtggagatacaaacgaactgtggctgcaccat

SEQ ID NO: 789556 - DNA, 446 bp, Homo sapiens
  misc_feature: NA.52.37.D04.7.454.light.4.multim50
ttgggtttgggggagctgctcagttaggacccagagggaaccatggaaaccccagcgcagcttctcttcctcctgctactctggctcccagatatcaccggagaaattgtgttgacgcagtctccaggcaccctgtctctgtctccaggggagagagccaccctctcctgcaggaccagtcagagtattagcaacagttacttagcctggtaccagcagaatcctggccaggctcccaggctcctcatctatggtgcgtccagcagggccactggcatcccagaccaggttcagtggcagtgggtctgggacagacttcactctcaccatcagcagggtggagcctgaggattttgcagtgtattattgtcagcactatggtaggtcacagtacacttttggccaggggaccaagctggagatcaaacgaactgtggctgcaccat

SEQ ID NO: 789557 - DNA, 433 bp, Homo sapiens
  misc_feature: NA.43.35.D02.7.454.light.4.multim50
ttgggtttgggggctttccctggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgctaacttattactgtcaacagtataatagttacccctggacgttcggccaagggaccagggtggaaatcaaacgaactgtggctgcaccatctgtcttcactcttcccgccatctgaactactcaca

SEQ ID NO: 789558 - DNA, 403 bp, Homo sapiens
  misc_feature: NA.49.22.B11.3.454.light.4.multim50
aaggggggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaaacctggccaggttcccaggctcctcgtctatgatgcgtccatcagggccactggcatcccagccaggttcagtggcagtgggtctgggacagacttcactctcaccttcggccaagggacacgactggaaattaaacgaactgtggctgcaccatctgtcttcatcttcccgccatctgatctctcgact

SEQ ID NO: 789559 - DNA, 460 bp, Homo sapiens
  misc_feature: NA.40.37.D04.2.454.light.4.multim50
ttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctggaccgtcctacgtcacgcccaaggcctccg

SEQ ID NO: 789560 - DNA, 457 bp, Homo sapiens
  misc_feature: NA.51.34.D01.2.454.light.4.multim50
ttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctcggtcactccg

SEQ ID NO: 789561 - DNA, 473 bp, Homo sapiens
  misc_feature: NA.51.34.D01.5.454.light.4.multim50
ttgggtttgggagggggtcaggctggaactgaggagcaggtgggggcacttctccctctaacactcttccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcgghcggggggaccgaaggtggaggatcaagacgaactgtggctgcaccactctgtt

SEQ ID NO: 789562 - DNA, 465 bp, Homo sapiens
  misc_feature: NA.48.38.D05.3.454.light.4.multim50
ttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgactgtggctgcaccatctgtcttcatcttcccgccta

SEQ ID NO: 789563 - DNA, 454 bp, Homo sapiens
  misc_feature: NA.52.34.D01.1.454.light.4.multim50
ttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcagtttgggtgttcggcggagggaccaagttgaccgtcctaggtcagcccaaggctccgkccccccg

SEQ ID NO: 789564 - DNA, 464 bp, Homo sapiens
  misc_feature: NA.48.52.E08.1.454.light.4.multim50
tcggcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcggagggaccaagctgaccgtcctaggtcagcccaaggctcgccccctcggt

SEQ ID NO: 789565 - DNA, 495 bp, Homo sapiens
  misc_feature: NA.4.34.D01.2.454.light.4.multim50
ttgggtttgggcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggagtccaggcagaagacgaggctgactattactgtcaatcagcagacagcggtgggacttataaagagttcggacggagggaccaagctgaccgtcctaggtcagcccaaggctgtccccccg

SEQ ID NO: 789566 - DNA, 473 bp, Homo sapiens
  misc_feature: NA.49.68.G02.7.454.light.4.multim50
aagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaaacagttatgtagcctggtaccagcagaaacctggccagtctcccaggctcctcatctatgctgcgtccagcagggccactggcatcccggacaggttcagtggcagtgggtctgggacaggacttctctctcaccatcagcagactggagcctgaagattttgcagtatattactgtcagcatgggagcattcgtgcgctcaccttcggcggagggaccaaggtggagagtcaaacgaactgtggctgcaccatctgtcttcatcttcccgccatctgatctctcgact

SEQ ID NO: 789567 - DNA, 446 bp, Homo sapiens
  misc_feature: NA.52.81.H04.1.454.light.4.multim50
ctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattgggggaaaatatgcttgctggtatcaacagcggccaggccagtcccctgtactggtcatctatctgaatagtaggcggccctctgggatccctgaccgattctctggctcccactctgggaacacagccactctgaccatcagcgggacccaggctttggatgaggctgactattactgtcaggcgtgggacaccatcactggagtaatattcggcggagggaccaggctgaccgtcctaggtcagcccaaggctgccccctcggtcactmc

SEQ ID NO: 789568 - DNA, 442 bp, Homo sapiens
  misc_feature: NA.52.81.H04.4.454.light.4.multim50
ctgcctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaattgggggataaatatgtttcctggtatcagcagaagccaggccagtcccctgcgttggtcatctatcaagataccaagaggcgctcagggatccctgagcgattctctggctccaactctggggacacagccactctgaccatcagcgggacccagactctggatgaggctgactattactgtcaggcgtgggacagcagcacgggggtgttcggcggagggaccaagctgaccgtcctaggtcagcccaaggctgccccckcggt

SEQ ID NO: 789569 - DNA, 464 bp, Homo sapiens
  misc_feature: NA.41.55.E11.2.454.light.4.multim50
tttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggt

SEQ ID NO: 789570 - DNA, 444 bp, Homo sapiens
  misc_feature: NA.49.82.H05.3.454.light.4.multim50
cacgaccggtgctcgatttagagagagtgtgttgggtttgggggctgtgggtccaggaggcagaactctgggtgtctcaccatggcctggatccctctacttctccccctcctcactctctgcacagactctgaggcctcctatgagctgacacagccaccctcggtgtcwgtgtccycaggacagacggccagkatcacctgctctggagatgcattgccaaascratatgcttaytggtaccagcagaagccrggccaggcccctgtsttgrtsatktataaagacwytgagaggscctcagggayccctgagcgattctctggctccagstcagsgacaacrgtcacrttcgrccatcagtggagtccrggcagaggacgaggctgactattaytgtcartcawcagacasyaktggyacttmtgtcttcggaactgaccg

SEQ ID NO: 789571 - DNA, 457 bp, Homo sapiens
  misc_feature: NA.49.45.E01.4.454.light.4.multim50
aagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccggggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcatcttcccgccatctgat

SEQ ID NO: 789572 - DNA, 323 bp, Homo sapiens
  misc_feature: NA.49.45.E01.6.454.light.4.multim50
ccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggagatcaaacgaactgtggctgcaccatctgtcttcatcttcccgccatctgatctctcgact

SEQ ID NO: 789573 - DNA, 453 bp, Homo sapiens
  misc_feature: NA.49.45.E01.9.454.light.4.multim50
agargarctgctcagttaggacccagagggaaccatggaarccccagckcagcttctcttcctcctgctactctggctcccagataccaccgsagaaattgtgttgacrcagtctccrgscaccctgtctttgtctccaggggamagwgccaccctctcctgcagggccagtcagagygttagyarcagttmtgtagcctggtaccarcagaaacctggccagkctcccaggctcctcatctatgrtgcatccamcagggccactggyatcccagccaggttcagtggcagtgggtctgkgacagagttcactctcaccatcagcagcctgcagtctgaagattttgctagtttattactgtcagcagtataatgtccgggctccggacactttcggcggagggaccaaggtggagatacaaacgaactgtggctcgcaccatctgtcttcta

SEQ ID NO: 789574 - DNA, 477 bp, Homo sapiens
  misc_feature: NA.51.55.E11.2.454.light.4.multim50
ttgggtttggggtgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtaggaaatacaaacgaactagtggctgcaccatctgtcttctattcccg

SEQ ID NO: 789575 - DNA, 455 bp, Homo sapiens
  misc_feature: NA.51.55.E11.8.454.light.4.multim50
ttgggtttggggwgtskskcwcaktcaggwcacmkcatgracatgmksktccctgctcagctcctgggactcctgctgctctggctcccagataccagatgtgacatccagatgacccagtctccatcctccctgtctgcatctataggagacagagtcaccatcacttgccgggcgagtcaggggcgtcagcattttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactwgtcaaaattataacagggccgttgcgctcactttcggcgggggtaccgaaggtggagatcaagcgaacgtgtggctgcaccatctgtt

SEQ ID NO: 789576 - DNA, 483 bp, Homo sapiens
  misc_feature: NA.48.86.H09.5.454.light.4.multim50
ttgggtttgggcttgggttdgggbtggggagcttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccscccg

SEQ ID NO: 789577 - DNA, 458 bp, Homo sapiens
  misc_feature: NA.51.27.C05.2.454.light.4.multim50
agggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcgggcggagggaccagtctgaccgtcctaggtcagcccaaggctgccccctcggtcactctcg

SEQ ID NO: 789578 - DNA, 457 bp, Homo sapiens
  misc_feature: NA.48.41.D08.5.454.light.4.multim50
agagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 789579 - DNA, 511 bp, Homo sapiens
  misc_feature: NA.18.78.H01.1.454.light.4.multim50
tctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccaccctcctccatactcgtactagtgcggcggtcgcgacgacggcgactagag

SEQ ID NO: 789580 - DNA, 437 bp, Homo sapiens
  misc_feature: NA.13.76.G10.1.454.light.4.multim50
agaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagaccccg

SEQ ID NO: 789581 - DNA, 474 bp, Homo sapiens
  misc_feature: NA.11.57.F02.1.454.light.4.multim50
ttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgccactctcg

SEQ ID NO: 789582 - DNA, 497 bp, Homo sapiens
  misc_feature: NA.9.53.E09.1.454.light.4.multim50
tttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgtccccccgtcactctgttcccgccctcctcagacgtatca

SEQ ID NO: 789583 - DNA, 406 bp, Homo sapiens
  misc_feature: NA.18.73.G07.1.454.light.4.multim50
agggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggcacctcagcctccctggccatcactgggctccaggctgatgatgaggctgattattactgccagtcctatgacatgaggctgagtggttcgtatgtcttcggatctgggaccaaggtcaccgtcctaagtcagcccaaggccaacccctctgtcactctgttcccrccctcctccatactcgta

SEQ ID NO: 789584 - DNA, 455 bp, Homo sapiens
  misc_feature: NA.8.28.C06.1.454.light.4.multim50
aggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgccaatc

SEQ ID NO: 789585 - DNA, 501 bp, Homo sapiens
  misc_feature: NA.18.59.F04.1.454.light.4.multim50
tagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactcgtcactctgttcccaccctcctccatactcgta

SEQ ID NO: 789586 - DNA, 518 bp, Homo sapiens
  misc_feature: NA.40.81.H04.1.454.light.4.multim50
cacgaccggtgctcgatttagtagtgtagattsrgctgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgcaccatctgtcttcatcttccccgccatctgaagtcgctaga

SEQ ID NO: 789587 - DNA, 452 bp, Homo sapiens
  misc_feature: NA.40.68.G02.1.454.light.4.multim50
agagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 789588 - DNA, 453 bp, Homo sapiens
  misc_feature: NA.3.10.A10.1.454.light.4.multim50
agggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaccccactcg

SEQ ID NO: 789589 - DNA, 449 bp, Homo sapiens
  misc_feature: NA.26.37.D04.1.454.light.4.multim50
ttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactgtggctgcacctac

SEQ ID NO: 789590 - DNA, 406 bp, Homo sapiens
  misc_feature: NA.18.9.A09.1.454.light.4.multim50
agggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 789591 - DNA, 497 bp, Homo sapiens
  misc_feature: NA.41.53.E09.1.454.light.4.multim50
tttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctcgccccctcggtcactctgttcccrccctcctcatagtat

SEQ ID NO: 789592 - DNA, 501 bp, Homo sapiens
  misc_feature: NA.12.53.E09.1.454.light.4.multim50
ttgggtttgggggctggggtcacaagaggcagcgctcttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtcactctgttcccaccctcctctacgtcgtat

SEQ ID NO: 789593 - DNA, 497 bp, Homo sapiens
  misc_feature: NA.22.28.C06.1.454.light.4.multim50
agcttcagctgtggtagagaagacaggattcaggacaatctccagcatggccggcttccctctcctcctcaccctcctcactcactgtgcaccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccaccctcctcacgcgtatgt

SEQ ID NO: 789594 - DNA, 489 bp, Homo sapiens
  misc_feature: NA.40.9.A09.1.454.light.4.multim50
agggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgtactttcggcggagggaccgaaggtggaggtcaaacgaactgtggctgcaccatctgtcttctatcttcccgccatctgaagtcgtcg

SEQ ID NO: 789595 - DNA, 481 bp, Homo sapiens
  misc_feature: NA.18.11.A11.1.454.light.4.multim50
agggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccatctgacta

SEQ ID NO: 789596 - DNA, 479 bp, Homo sapiens
  misc_feature: NA.49.85.H08.1.454.light.4.multim50
tcgcgggcacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgtcctgagtccagccccaacggcccgc

SEQ ID NO: 789597 - DNA, 444 bp, Homo sapiens
  misc_feature: NA.49.81.H04.1.454.light.4.multim50
caggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtcttcta

SEQ ID NO: 789598 - DNA, 479 bp, Homo sapiens
  misc_feature: NA.19.10.A10.1.454.light.4.multim50
aaggggcagagctctggagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgaagattttgcagtgtattactgtcaacgatatgatgagtcacctccgtggtggacatttggccaggggaccaaggttgaagtcaaacgaactgtggctgcaccatctgtcttcatcttccccg

SEQ ID NO: 789599 - DNA, 521 bp, Homo sapiens
  misc_feature: NA.41.19.B08.1.454.light.4.multim50
agggcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccgccctcctcattgta

SEQ ID NO: 789600 - DNA, 454 bp, Homo sapiens
  misc_feature: NA.26.12.B01.1.454.light.4.multim50
tccgcggggagagctctggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccaagctggagatcaaccgaactgtggctgcaccatctgtt

SEQ ID NO: 789601 - DNA, 476 bp, Homo sapiens
  misc_feature: NA.12.85.H08.1.454.light.4.multim50
tcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtcctaagtcagcccaaggctgccccctcggtcactctgttcccat

SEQ ID NO: 789602 - DNA, 473 bp, Homo sapiens
  misc_feature: NA.3.79.H02.1.454.light.4.multim50
aagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctcggtccactc

SEQ ID NO: 789603 - DNA, 494 bp, Homo sapiens
  misc_feature: NA.49.28.C06.2.454.light.4.multim50
tgctcgatttagagtatacatatwgagsyytggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgttkgccgttcggccaccc

SEQ ID NO: 789604 - DNA, 491 bp, Homo sapiens
  misc_feature: NA.48.30.C08.1.454.light.4.multim50
aagggaaagggggaggttctttctaagggaaagggaaagggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccgccta

SEQ ID NO: 789605 - DNA, 491 bp, Homo sapiens
  misc_feature: NA.43.87.H10.1.454.light.4.multim50
ttgggtttggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgaccgtcctaggtcagcccaaggctgccccctcggtcactctcgttcccgccctcctcacta

SEQ ID NO: 789606 - DNA, 453 bp, Homo sapiens
  misc_feature: NA.49.56.F01.2.454.light.4.multim50
aacacacaaagggggcaggagtcagtctcagtcaggacccagcatggacatgagggtccccgctcagctcctggggctcctgctactctggctccgaggtgccagatgtgacatccagatgacccagtctccatcttccctgtctgcatctctgggagacagagtcaccatcacttgccaggcgagtcagaccattggcaactttttaaattggtatcaacacaaaccagggaaagcccctaaactcctgatctatgctgcatccactttgcaaagtggggtcccttcaaggttccgtggcggtggatctgggacagatttcgctctcaccatcagcagtctccagcctgaagattttgcgacttactactgtcaacagagtttctctgacctcactttcggcggagggaccacggtggacatcaaacgaactgtggctgcaccatctgtctt

SEQ ID NO: 789607 - DNA, 455 bp, Homo sapiens
  misc_feature: NA.49.33.C11.1.454.light.4.multim50
tttgggtttggggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggagatcaaacgaactgtggctgcaccatctgtt

SEQ ID NO: 789608 - DNA, 451 bp, Homo sapiens
  misc_feature: NA.26.78.H01.1.454.light.4.multim50
cagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgttt

SEQ ID NO: 789609 - DNA, 514 bp, Homo sapiens
  misc_feature: NA.49.61.F06.1.454.light.4.multim50
cacgaccggtgctcgatttagctacgctctaagggaaagggagaagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggagatcaaacgaactgtggctgcaccatctgtcttctatcttcccgccatctgatctctcgact

SEQ ID NO: 789610 - DNA, 403 bp, Homo sapiens
  misc_feature: NA.2.76.G10.2.454.light.4.multim50
agggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctctgtcgagcgt

SEQ ID NO: 789611 - DNA, 435 bp, Homo sapiens
  misc_feature: NA.49.41.D08.4.454.light.4.multim50
agtcagacccagtcaggacacagcatggacatgagggtccccgctcagctcctggggctcctgctgctctggctcccaggtgccaaatgtgacatccagatgacccagtctccttcccttttgtctgcatctgttggagacagagtcaccatcacttgccgggccactgagaacattaatcgctggttggcctggtatcagcagaaaccagggaaagcccctgaggccctcatctatctggcgtctagtttagagagtggggtcccatcaagattcagcggcaatggatctgggacagaattcactctcaccattagcagcctgcagcctgatgatcttgcaacttattactgccaacattataatagttatatgtacatttttggccaggggaccaagttggagatcaaacgaactgtggctgcaccatcttcg

SEQ ID NO: 789612 - DNA, 438 bp, Homo sapiens
  misc_feature: NA.51.45.E01.2.454.light.4.multim50
ctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagcccaaggctcgcccccttcc

SEQ ID NO: 789613 - DNA, 473 bp, Homo sapiens
  misc_feature: NA.48.68.G02.2.454.light.4.multim50
aggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccgtccaa

SEQ ID NO: 789614 - DNA, 456 bp, Homo sapiens
  misc_feature: NA.49.57.F02.2.454.light.4.multim50
ttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgtt

SEQ ID NO: 789615 - DNA, 479 bp, Homo sapiens
  misc_feature: NA.48.34.D01.5.454.light.4.multim50
ttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctcgccccctcggtcactctcgttcccgccctyct

SEQ ID NO: 789616 - DNA, 480 bp, Homo sapiens
  misc_feature: NA.49.34.D01.3.454.light.4.multim50
ttgggtttggggggagtcagtcccaaccaggacacagcatggacatgagggtccctgctcagctcctggggctcctgctgctctggctctcaggtgccagatgtgacatccagatgacccagtctccatcctccctgtctgcatgctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 789617 - DNA, 461 bp, Homo sapiens
  misc_feature: NA.17.29.C07.1.454.light.4.multim50
aagggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctcgccccccg

SEQ ID NO: 789618 - DNA, 504 bp, Homo sapiens
  misc_feature: NA.40.35.D02.2.454.light.4.multim50
ttgggtttgggcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaaggctccgg

SEQ ID NO: 789619 - DNA, 469 bp, Homo sapiens
  misc_feature: NA.48.42.D09.4.454.light.4.multim50
agggaaagggggaagagctgctcagttaggacccagagggaaccatggaaaccccagcgcagcttctcttcctcctgctactctggctcccagatagcaccggagaaatcgtgttgacgcagtctccaggcaccctgtctgtgtctccaggggaaagagccaccctctcctgcagggccagtcagagtgttagcagcagctacttagcctggtaccagcagaaaccgggccaggctcccaggctcctcatctatggtgcatccagcagggccactggcatcccagacaggttcagttgcagtgggtctgggacagacttcactctcaccatcagcagactggagcctgaagattttgcaatttattactgtcagcagtatggtacctcacccaggtacacttttggccaggggaccaagctggagatcaaacgaactgtggctgcacctatgtcttctatccttccccg

SEQ ID NO: 789620 - DNA, 484 bp, Homo sapiens
  misc_feature: NA.52.33.C11.3.454.light.4.multim50
ttgggtttgggggggttgggtttggggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagcccggccaggcccctgtcttgcttatttataaagactttgagaggccctcagggacccctgagcgattctctggctccagctcagcgacaacagtcacgttgaccatcagtggagtccaggcagaggacgaggctgactattactgtcagtcatcagacagcagtggcacttatgtcgtattcggcggagggaccaaactgaccgtcctaggtcagcccaaggctcgccccccggtcactctgttccccg

SEQ ID NO: 789621 - DNA, 481 bp, Homo sapiens
  misc_feature: NA.52.72.G06.2.454.light.4.multim50
ctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtcactctcgttcccgccctcctctatacg

SEQ ID NO: 789622 - DNA, 501 bp, Homo sapiens
  misc_feature: NA.40.55.E11.1.454.light.4.multim50
ttgggtttgggcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaaggctccgg

SEQ ID NO: 789623 - DNA, 475 bp, Homo sapiens
  misc_feature: NA.48.80.H03.2.454.light.4.multim50
aagggaaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccktcctaagtcagcccaaggctgccccctcggtcactctgttcccgyct

SEQ ID NO: 789624 - DNA, 455 bp, Homo sapiens
  misc_feature: NA.41.37.D04.2.454.light.4.multim50
ttgggtttgggggcaggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcaccatctgtcttw

SEQ ID NO: 789625 - DNA, 493 bp, Homo sapiens
  misc_feature: NA.48.35.D02.3.454.light.4.multim50
ttgggtttgggywsgryykgkgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctcgcccccg

SEQ ID NO: 789626 - DNA, 463 bp, Homo sapiens
  misc_feature: NA.16.86.H09.1.454.light.4.multim50
ttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctcgcccccg

SEQ ID NO: 789627 - DNA, 461 bp, Homo sapiens
  misc_feature: NA.43.55.E11.1.454.light.4.multim50
tttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccac

SEQ ID NO: 789628 - DNA, 440 bp, Homo sapiens
  misc_feature: NA.49.72.G06.1.454.light.4.multim50
agaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgttt

SEQ ID NO: 789629 - DNA, 457 bp, Homo sapiens
  misc_feature: NA.43.24.C02.1.454.light.4.multim50
tagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatagaaacaactatttggattggtatctgcagaagccagggcagcctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgctcactttcggcggagggaccaaggtggagatcaaacgaactgtggctgcaccta

SEQ ID NO: 789630 - DNA, 512 bp, Homo sapiens
  misc_feature: NA.48.29.C07.1.454.light.4.multim50
agggaaagggggagcgagtagggaaagggggggggagsswarskgkgctgtgggtccaggaggcagaactctgggtgtctcaccatggcctgggtccccctacttctccccctcctcactctctgcacaggctctcaggcctcctatgagttgacacagccaccctcggtgtcagtgtccccaggacagacggccaggatcacctgctctggagatggattgccaacacaatatgcgtactggtaccagaagaagccaggccaggcccctgttttggtgatatatcaagacactcagagggcctcagggacccctgagcggttctctggctccagctcaggggcaacagtcgcgttgacaatcagggaagtccaggcagaggacgaggctgactattactgtcagtctgcagacaacggaggtacttacttggtcttcggcggagggaccaagttgaacgtcctgggtcagcccaaggctgccccctcggtcactctcgttcccgccctcct

SEQ ID NO: 789631 - DNA, 438 bp, Homo sapiens
  misc_feature: NA.52.75.G09.3.454.light.4.multim50
agggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcaccatctgtt

SEQ ID NO: 789632 - DNA, 443 bp, Homo sapiens
  misc_feature: NA.49.54.E10.2.454.light.4.multim50
aacacacaaaggggcagtcccagtcaggacacagcatggacatgagggtccccgctcagctcctggggctcctgctgctctggctcccaggtgccagatgtgacatccagttgacccagtctccatccttcctgtctgcatctgtcggagacagagtcaccatcacttgccgggccagtcagggcgttagtagttatttagcctggtatcaacaaaaaccagggaaagcccctaacctcctgatatatgctgcaaccactttgcaaagtggggtcccatcaaggttcagcggcagtggatctgggacagagttcactctcactatcagcagcctgcagcctgaagattttgcaacttattattgccatcaagttgatgcttacccgctcactttcggcggagggaccaaggtggagatcagacgaactgtggctgcaccattc

SEQ ID NO: 789633 - DNA, 482 bp, Homo sapiens
  misc_feature: NA.49.55.E11.1.454.light.4.multim50
tttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctgccccctcggtcactctcgttcccta

SEQ ID NO: 789634 - DNA, 464 bp, Homo sapiens
  misc_feature: NA.40.38.D05.2.454.light.4.multim50
ttgggtttgggggtggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaaggctccgcccg

SEQ ID NO: 789635 - DNA, 466 bp, Homo sapiens
  misc_feature: NA.49.29.C07.3.454.light.4.multim50
agggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtcttcatcttccccgccat

SEQ ID NO: 789636 - DNA, 465 bp, Homo sapiens
  misc_feature: NA.13.38.D05.3.454.light.4.multim50
ttgggtttggggtgggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgaccgtcctcggtcagcccaaggctcgcccc

SEQ ID NO: 789637 - DNA, 453 bp, Homo sapiens
  misc_feature: NA.48.25.C03.1.454.light.4.multim50
aggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgccat

SEQ ID NO: 789638 - DNA, 515 bp, Homo sapiens
  misc_feature: NA.43.23.C01.1.454.light.4.multim50
ttgggattgggaacctatgaacattctgtagggattggggctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctcgttcccaccctcctctactactcta

SEQ ID NO: 789639 - DNA, 445 bp, Homo sapiens
  misc_feature: NA.4.34.D01.1.454.light.4.multim50
ttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagattttgcggtttattactgtcagcagtatgataactggctgtacacttttggccaggggaccaagctggagatcaggcgaactgtggctgcaccta

SEQ ID NO: 789640 - DNA, 455 bp, Homo sapiens
  misc_feature: NA.49.68.G02.1.454.light.4.multim50
aaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtcttcatcttmcccgccta

SEQ ID NO: 789641 - DNA, 508 bp, Homo sapiens
  misc_feature: NA.53.53.E09.1.454.light.4.multim50
ttgggtttgggcacgaccggtgctcgatttagagtgagctcgttggggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaaactgaccgtcctaggtcagcccaaggctcgccccctcggtcactctcgtt

SEQ ID NO: 789642 - DNA, 450 bp, Homo sapiens
  misc_feature: NA.48.41.D08.4.454.light.4.multim50
catgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccgccta

SEQ ID NO: 789643 - DNA, 461 bp, Homo sapiens
  misc_feature: NA.52.41.D08.1.454.light.4.multim50
cagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaggcggctccaacatcggagggaatactgtgaactggtaccagcaactcccagggacggcccccagactcctcatctttagtcataatcagcggccctcaggggtccctgaccgattctctggctccaagtctggcacctcagcctccttggccatcagtgggctccagtctgacgatgaggctgattacttctgtgcaacttgggatgacagcctgaatggtccggtgttcggcggagggaccaagcttaccgttctgggtcagcccaaggctgccccctcggt

SEQ ID NO: 789644 - DNA, 456 bp, Homo sapiens
  misc_feature: NA.49.42.D09.1.454.light.4.multim50
agggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtttcmtrtt

SEQ ID NO: 789645 - DNA, 495 bp, Homo sapiens
  misc_feature: NA.3.1.A01.1.454.light.4.multim50
agggcacgaccggtgctcgatttagacgtctcataagggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactgtggctgcaccatctgtcttyatcttcccgccatctgaga

SEQ ID NO: 789646 - DNA, 450 bp, Homo sapiens
  misc_feature: NA.47.55.E11.2.454.light.4.multim50
ttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtcactctgttcccaccctcctctacgtgagct

SEQ ID NO: 789647 - DNA, 485 bp, Homo sapiens
  misc_feature: NA.51.12.B01.2.454.light.4.multim50
tccgcgggggtgggctcagaagcagagttctggggtgtctccaccatggcctggacccctctctggctcactctcctcactctttgcataggttctgtggtttcttctgagctgactcaggaccctactgtgtctgtggccttggggcagacagtcaggatcacatgccaaggagacaacctcagaatgttttatgcacactggtaccagcataagccaggacaggcccctctacttgtcatctatggtagagacaaccggccctcagggatcccagaccgattctctggctccatctcaggaaacacagcttccttgaccatcactggggctcaggcggaagatgaggctgactattactgtaatacccgggacagcagtgataaggtcatgatattcggcggagggacgaagctgaccgtcctacgtcagcccaaggctcgccccctcggtcactccgttcccaccctcctctcgtagctacc

SEQ ID NO: 789648 - DNA, 484 bp, Homo sapiens
  misc_feature: NA.49.35.D02.1.454.light.4.multim50
ttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctgccccctcggtcactctcgttcccrcctt

SEQ ID NO: 789649 - DNA, 466 bp, Homo sapiens
  misc_feature: NA.48.27.C05.5.454.light.4.multim50
agggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcgccccctcggt

SEQ ID NO: 789650 - DNA, 468 bp, Homo sapiens
  misc_feature: NA.43.53.E09.1.454.light.4.multim50
tttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccctacstaccg

SEQ ID NO: 789651 - DNA, 466 bp, Homo sapiens
  misc_feature: NA.49.80.H03.5.454.light.4.multim50
aagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtcttcatcttcccgccta

SEQ ID NO: 789652 - DNA, 472 bp, Homo sapiens
  misc_feature: NA.48.61.F06.4.454.light.4.multim50
aggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccgccta

SEQ ID NO: 789653 - DNA, 478 bp, Homo sapiens
  misc_feature: NA.52.29.C07.1.454.light.4.multim50
agggaaaggggctggggagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgcttctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcactctcgccg

SEQ ID NO: 789654 - DNA, 477 bp, Homo sapiens
  misc_feature: NA.13.11.A11.2.454.light.4.multim50
aggggrgaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaagagccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgccatctgatagtacgtga

SEQ ID NO: 789655 - DNA, 458 bp, Homo sapiens
  misc_feature: NA.51.33.C11.3.454.light.4.multim50
ttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctcgccccctcggtcactccg

SEQ ID NO: 789656 - DNA, 463 bp, Homo sapiens
  misc_feature: NA.40.73.G07.1.454.light.4.multim50
agggggaagagctgctcagttaggacccagagggaaccatggaaaccccagcgcaacttctcttcctcctgctactctggctcccagaaaccaccggagaaatagtgttgaagcagtctccagacaccctgtctttgtctccaggggagagagccaccctctcctgcagggccagtcagagtgttagcagcaactccattgcctggtaccagcagaaacctggccagtctcccaggctcctcatctatggtgcttcgaccaggctcaccggcatccctgacaggttcactgccagtgggtctgggacagacttcactctcatcatcaccagactagaacctgaggattttgcagtgtatttttgtcaacaacatgataagtcaccgttcagctttggccgggggacccaggtggagatcagacgaactgtggctgcaccatctgtcttcatcttccccgccta

SEQ ID NO: 789657 - DNA, 503 bp, Homo sapiens
  misc_feature: NA.49.27.C05.3.454.light.4.multim50
agggtttgggcacgaccagtgctcgatttagacgcgagggttagggtttgggtgagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatcaagcgaactgtggctgcacctatctgtcttcatccttcccgccat

SEQ ID NO: 789658 - DNA, 487 bp, Homo sapiens
  misc_feature: NA.48.87.H10.4.454.light.4.multim50
ttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctcgccccctcggtcactctcgttcccrccctcctctatgtatact

SEQ ID NO: 789659 - DNA, 461 bp, Homo sapiens
  misc_feature: NA.49.58.F03.3.454.light.4.multim50
aagggaaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttccccgt

SEQ ID NO: 789660 - DNA, 447 bp, Homo sapiens
  misc_feature: NA.49.53.E09.4.454.light.4.multim50
ttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaaggctccgg

SEQ ID NO: 789661 - DNA, 503 bp, Homo sapiens
  misc_feature: NA.48.59.F04.3.454.light.4.multim50
tagggattggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggaccaagttgaccgtcctaggtcaacccaaggctgccccctcggtcactctgttccckccctcctctatgtatact

SEQ ID NO: 789662 - DNA, 470 bp, Homo sapiens
  misc_feature: NA.19.67.G01.2.454.light.4.multim50
ttgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaattatttttctatcctccgtggacgttcggccaagggaccagggtggaaatcagacgaactgtggctgcaccatctgtctt

SEQ ID NO: 789663 - DNA, 466 bp, Homo sapiens
  misc_feature: NA.52.37.D04.3.454.light.4.multim50
ttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatcttccccg

SEQ ID NO: 789664 - DNA, 483 bp, Homo sapiens
  misc_feature: NA.51.55.E11.1.454.light.4.multim50
ttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggcctgccccctcggtcactactcgttccccg

SEQ ID NO: 789665 - DNA, 73 bp, Homo sapiens
  misc_feature: NA.53.45.E01.1.454.light.4.urt
cggccctcagggatccctgagcgattctctggctccaactctgggaacacggccactctgaccataagcaggg

SEQ ID NO: 789666 - DNA, 73 bp, Homo sapiens
  misc_feature: NA.53.60.F05.1.454.light.4.urt
cggccctcagggatccctgagcgattctctggctccaactctgggaacacggccaccctgaccataagcaggg

SEQ ID NO: 789667 - DNA, 367 bp, Homo sapiens
  misc_feature: NA.53.28.C06.1.454.light.4.urt
tgggtccaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtgggcccaggtggaggatgaagctgattactactgttactcaacagacagga

SEQ ID NO: 789668 - DNA, 366 bp, Homo sapiens
  misc_feature: NA.26.75.G09.1.454.light.4.urt
aggggagagctgctcagttaggacccagagggaaccatggaaaccccagcgcagcttctcttcctcctgctactctggctcccagattccaccgcagaaattgtgctgacgcagtctcccgggaccctgtctttgtctccaggggaaagagccaccctctcctgcagggccagtcagagtgttagcaactactatttagcctggtaccaacagaactggccaggctcccggctcctcatctatgatgcatccaaccgggccactggcatcccagacaggttcagtggcagtgggtctgagacagacttcactctcactatcagcagactggagcctgaagattttgcactttattactgtcagcag

SEQ ID NO: 789669 - DNA, 240 bp, Homo sapiens
  misc_feature: NA.47.41.D08.1.454.light.4.urt
caggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgtatttaaattggtatcaccagaaaccagggaaagcccctaagctcctgatctatgctgcatccaatttg

SEQ ID NO: 789670 - DNA, 239 bp, Homo sapiens
  misc_feature: NA.47.68.G02.1.454.light.4.urt
caggacacagcatggacatgagggtccctgctcagctcctggggctcctgctactctggctccgaggtgccagatgtgacatccagatgacccagtctccatcctccctgtctgcatctgtaggagacagagtcaccatcacttgccaggcaagtcagagcattaacagcgatttaaattggtatcaccagaaaccagggaaagcccctaactcctgatctatgctgcatccaagtttg

SEQ ID NO: 789671 - DNA, 93 bp, Homo sapiens
  misc_feature: NA.53.9.A09.1.454.light.4.urt
ctgcacaggctctgaggcctcctatgagctgacacagccaccctcggtgtcagtgtccccaggacagacagccagcatcacctgctctggaga

SEQ ID NO: 789672 - DNA, 650 bp, Homo sapiens
  misc_feature: NA.17.25.C03.G17C3.Sanger.heavy.1.sanger
gaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctggggccagggagccctggtcaccgtcacgtcagcttccaccaagggcccatccgtcttccccctggcgccctgctccaggagcacctccgagagcacagccgccctgggctgcctggtcaaggactacttccccgaaccggttactgtctcttggaattcccgggccc

SEQ ID NO: 789673 - DNA, 650 bp, Homo sapiens
  misc_feature: NA.3.70.G04.G3G42.Sanger.heavy.1.sanger
cggtgctcgatttagtgtagtgtgaagggaaagggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccagcccggggggtccctgagactctcctgtgaagtctctgggttcactgtcagtagcaactacatgaactgggtccgccaggctccagggaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactggggcctgggaaccctggtcaccgtctcctcagcctccaccaagggcccatcggtcttccccctggcgccctgctccaggagcacctccgagagcacagcggccctgggctgcctggtcaaggactacttccccgaaccggttactgtctcttggaattccgggg

SEQ ID NO: 789674 - DNA, 650 bp, Homo sapiens
  misc_feature: NA.4.26.C04.G4C4.Sanger.heavy.1.sanger
cggtgctcgatttagtctagcgactttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttggtggagtctgggggaggcttggtacagcctggggggtccccgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaagaacacgttatatctgcaaatgaacagcctgcgagccgacgacacggccgtatattactgtgcgaaatgccttattgcgaccgagcgtagcagtggctggtgcaactggctcgacccctggggccagggaacccatgtcaccgtctcctcagcctccaccaagggcccatcggtcttccccctggcgccctgctccaggagcacctccgagaacacagcggccctgggctgcctggtcaagactact

SEQ ID NO: 789675 - DNA, 650 bp, Homo sapiens
  misc_feature: NA.8.33.C11.G8C11.Sanger.heavy.1.sanger
ggtgctcgatttagagtgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctatgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccagcgggagttccaagtactcctttgacgtctggggccagggtaccctggtcaccgtctcctcagcctccaccaagggcccatcggtcttccccctggcgccctgctccaggagcacctccgagagcacagcggccctgggctgcctggtcaaggactacttccccgaaccggttactgtctcttggaatt

SEQ ID NO: 789676 - DNA, 650 bp, Homo sapiens
  misc_feature: NA.8.38.D05.G8D5.Sanger.heavy.1.sanger
gaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacg

SEQ ID NO: 789677 - DNA, 650 bp, Homo sapiens
  misc_feature: NA.8.39.D06.G8D6.Sanger.heavy.1.sanger
  modified_base (579)..(579): a, c, t, g, unknown or other
gtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagcttttgaattttggggccaagggacaatggtcatcgtctcctcagcctccaccaagggcccatcggtcttccccctggcaccctcctccaagagcacctctgggggcacagcggccctgggctgcctggtcaaggactacttccccgaaccggttactgtctcttgnattccggggccctcaccagtggtgtccatacctttcccgcggtgcttcagagttcccggtttgtattccct

SEQ ID NO: 789678 - DNA, 650 bp, Homo sapiens
  misc_feature: NA.8.42.D09.G8D9.Sanger.heavy.1.sanger
  modified_base (636)..(636): a, c, t, g, unknown or other
ggtgctcgatttagacacatacgcagggaaaggggggagaggagcccagcactgggattccgaggtgtgtccattcggtgatcagcactgaacacagaggactcaccatggagttctggctgggctgggttttccttgttgcaatttcaaaaggtgtccagtgtgaggtgcagctggtggagaatggagggggcttgatccagccgggggggtccctgagactctcctgtgcagcctctggcttcaccatcagtagagactacatgagctgggcccgccaggctccagggaaggggctggagtgggtctcagttatttatcgcgatggtggcacacactacgcagactccgtgaagggcagattcaccgtctccagagacaattccaagaacatggtgtatcttcaaatgaacagactaacagccgaggacacggccgtatattactgtgcgagacatgactacggtgagccctggggccagggaaccctggtcaccgtctcctcagcctccaccaagggcccatcggtcttccccctggcgccctgctccaggagcacctccgagagcacagcggccctgggctgcctggtcaaggactacttccccgaaccggttactgtctcttggaattccngggccctcaccagt

SEQ ID NO: 789679 - DNA, 650 bp, Homo sapiens
  misc_feature: NA.9.1.A01.G9A1.Sanger.heavy.1.sanger
ggtgctcgatttagacgtctcatcaaggaaggaagggggggagaggagccccagccttgggattcccaagtgttttcattcagtgatcaggactgaacacagaggactcaccatggagtttgggctgagctggattttccttgctgctattttaaaaggtgtccagtgtgaggtgcaactggtggagtctgggggaggctcggtcaagcctggggagtcccttagactctcctgtgcaacctctggattcaatttcgacatcgcctggatgagttgggcccgccaggctccagggaaggggctggagtgggttggacgtcttaaaagcaagggtagcggtgggacagcagactacgcttcatccgtgaagggcagattcagcatttccagagacgatgcaagacagatgatgtatttacagatgaacagcctaaaaatcggagacacagccctatatttctgcgtcttcatttcgcagtgggagctccggtttacggtcggtgacttctggggccggggagccatggtcaccgtctcctcagcctccaccaagggcccatcggtcttccccctggcgccctgctccaggagcacctccgagagcacagcggccctgggctgcctggtcaaggactacttccccgaaccgg

SEQ ID NO: 789680 - DNA, 650 bp, Homo sapiens
  misc_feature: NA.9.12.B01.G9B1.Sanger.heavy.1.sanger
gaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccaggaacacgctgtatcttcaaatgaacagcctgagagtcgaggacacggctgtatattactgtgcgagagatgtgtacgcttttgatatctggggccaagggacaatggtcaccgtctcttcagcctccaccaagggcccatcggtcttccccctggcgccctgctccaggagcacctccgagagcacagcggccctgggctgcctggtcaaggactacttccccgaaccggtgacggtgtcgtggaattccc

SEQ ID NO: 789681 - DNA, 650 bp, Homo sapiens; identical to SEQ ID NO: 789679
  misc_feature: NA.9.31.C09.G9C9.Sanger.heavy.1.sanger

SEQ ID NO: 789682 - DNA, 650 bp, Homo sapiens
  misc_feature: NA.9.34.D01.G9D1.Sanger.heavy.1.sanger
ggtgctcgatttagatcgtctgtgttgggtttgggcatgtgtgagttttgtcacaagatttgggctcaactttcttgtccaccttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccccgaaccggttactgtctcttggaattccggggccctcaccagtggtgtccatacctttcccgcggtgcttcagagttccggtttgtattccctgtcaagtgtcgtgacggtacca

SEQ ID NO: 789683 - DNA, 645 bp, Homo sapiens
  misc_feature: NA.9.34.D01.G9D1F8-4.Sanger.heavy.1.sanger
ggtgctcgatttagatcgtctgtgttgggtttgggcatgtgtgagttttgtcacaagatttgggctcaactttcttgtccaccttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccccgaaccggttactgtctcttggaattccggggccctcaccagtggtgtccatacctttcccgcggtgcttcagagttccggtttgtattccctgtcaagtgtcgtgacgg

SEQ ID NO: 789684 - DNA, 650 bp, Homo sapiens
  misc_feature: NA.10.1.A01.G10A1.Sanger.heavy.1.sanger
ggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtctgggggaggcgtggtccagcctgggaggtccctgagactctcctgtgcagcctctgggttcaccttcaatacctatggcatgcactgggtccgccaggctccaggcaaggggctggagtgggtggctcttatctcatatgatggaaatgttaaattttatgcagactccgtgaagggccgattcaccatctccagagacaattccaggaacaccctgtatctgcaaatgaacagcctgagagctgacgacacggctgtttattactgtgcgacagagcagctgctaaatccttttgctatttggggccaagggacaatggtcgccgtctcttcagcctccaccaagggcccatcggtcttccccctggcgccctgctccaggagcacctccgagagcacagcggccctgggctgcctggtcaaggactacttccccgaaccggttactgtctcttggaattccggggcc

SEQ ID NO: 789685 - DNA, 650 bp, Homo sapiens
  misc_feature: NA.10.1.A01.G10A1-2.Sanger.heavy.1.sanger
ggtctcgatttagacgtctcatcaggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtctgggggaggcgtggtccagcctgggaggtccctgagactctcctgtgcagcctctgggttcaccttcaatacctatggcatgcactgggtccgccaggctccaggcaaggggctggagtgggtggctcttatctcatatgatggaaatgttaaattttatgcagactccgtgaagggccgattcaccatctccagagacaattccaggaacaccctgtatctgcaaatgaacagcctgagagctgacgacacggctgtttattactgtgcgacagagcagctgctaaatccttttgctatttggggccaagggacaatggtcgccgtctcttcagcctccaccaagggcccatcggtcttccccctggcgccctgctccaggagcacctccgagagcacagcggccctgggctgcctggtcaaggactacttccccgaaccggttactgtctcttggaattcccggggcc

SEQ ID NO: 789686 - DNA, 650 bp, Homo sapiens
  misc_feature: NA.10.35.D02.G10D2.Sanger.heavy.1.sanger
ggtgctcgatttagcacacgatagttgggtttggggagctctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttggttaagccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttccccctggcgccctgctccaggagcacctccgagagcacagcggccctgggctgcctggtcaaggactacttccccgaaccggtg

SEQ ID NO: 789687 - DNA, 650 bp, Homo sapiens
  misc_feature: NA.10.38.D05.G10D5.Sanger.heavy.1.sanger
gaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcctggtcaaggactacttccccgaaccggtgacggtgtcgtggaaattccggggccctc

SEQ ID NO: 789688 - DNA, 329 bp, Homo sapiens
  misc_feature: NA.10.53.E09.G10E9.Sanger.heavy.1.sanger
ggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcactggggccagggcaccctggtcaccgtctcctcagcctccaccaagggcccatcggtctttccccctggcaccctcctccaagagcacctctgggggcacagcggccctgggctgcctggtccaggactacttccccgaaccggttactgtctctttggaattcc

SEQ ID NO: 789689 - DNA, 650 bp, Homo sapiens
  misc_feature: NA.10.6.A06.G10A6.Sanger.heavy.1.sanger
  modified_base (650)..(650): a, c, t, g, unknown or other
cggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtctgggggaggcctggtcaagccgggggggtctctgagactgtcctgtgttgcctctggattccctctcaggagtttcagcatgaactgggtccgccaggctccagggaagggcctggagtgggtcgcaaccatcagcagtatttccagttacatatactacgcagaatctgtgaagggccgcttcaccatctccagagacgacgccaggaactcaatgtggctgcaaatgaacagcctgggagccgaggacacggcaagatattactgtgcgagagctttaatggtcggtgataactggaacgacatctttgacttttggggccagggaaccctggtcaccgtctcttcagcctccaccaagggcccatcggtcttccccctggcaccctcctccaagagcacctctgggggcacagcggccctgggctgcctggtcaaggactacttccccgaaccggtgacggtgtcgn

SEQ ID NO: 789690 - DNA, 650 bp, Homo sapiens
  misc_feature: NA.10.71.G05.G10G5.Sanger.heavy.1.sanger
gctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcatcacctggtattgtgacttccggggccagggaaccgtggtcaccgtctcttcggcctccaccaagggcccatcggtcttccccctggcgccctgctccaggagcacctccgagagcacagcggccctgggctgcctggtcaaggactacttccccgaaccggttactgtctcttggaaattccggggccctcaccagtggtgtccatacctt

SEQ ID NO: 789691 - DNA, 650 bp, Homo sapiens
  misc_feature: NA.10.79.H02.G10H2.Sanger.heavy.1.sanger
ggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttccccctggcgccctgctccaggagcacctccgagagcacagcggccctgggctgcctggtcaaggactacttccccgaac

SEQ ID NO: 789692 - DNA, 650 bp, Homo sapiens
  misc_feature: NA.10.9.A09.G10A9.Sanger.heavy.1.sanger
cgatttagcgagacgcgcggggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccagcgggagttccaagtactcctttgacgtctggggccagggtaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaattc

SEQ ID NO: 789693 - DNA, 455 bp, Homo sapiens
  misc_feature: NA.11.71.G05.G11G5.Sanger.heavy.1.sanger
  modified_base (200)..(200): a, c, t, g, unknown or other
ggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtggcccngcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgactacgggggcgtctttgactactggggccagggaaccctggtcaccgtctcctcagcctccaccaagggcccatcggtcttccccctg

SEQ ID NO: 789694 - DNA, 629 bp, Homo sapiens
  misc_feature: NA.13.21.B10.G13B10.Sanger.heavy.1.sanger
gctcgatttagtgtcgtcgcaagagagaggggggggtcaaccgccatccttgccctcctcctggctgttctccaaggagtctgtgccgaggtgcagctggtgcagtctggagcagaggtgaaaaagcccggggagtctctgaagatctcctgtaagggttttggaaacagctttatcagccactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcaaaatacgcatactacggtaattcaccggcttactactacaacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggttactgtctcttggattccggggccctcaccagtggtgtccatacctttcccgcg

SEQ ID NO: 789695 - DNA, 650 bp, Homo sapiens
  misc_feature: NA.13.71.G05.G13G5.Sanger.heavy.1.sanger
gctcgatttagtgtcgtcgcaagagagaggggggggtcaaccgccatccttgccctcctcctggctgttctccaaggagtctgtgccgaggtgcagctggtgcagtctggagcagaggtgaaaaagcccggggagtctctgaagatctcctgtaagggttttggaaacagctttatcagccactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcaaaatacgcatactacggtaattcaccggcttactactacaacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggttactgtctcttggaattccggggccctcaccagtggtgtccatacctttcccgcggtgcttcagagttccggttt

SEQ ID NO: 789696 - DNA, 638 bp, Homo sapiens
  misc_feature: NA.26.60.F05.G26F5.Sanger.heavy.1.sanger
cggtgctcgatttagtacgtcatcagggaaagggggagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggcgtctgggggagacttggtacaccctggggggtccctgagactctcctgtgcagcctctggattcacctttagcaactctgtcatgggctgggtccgccaggctccggggaaggggctggcgtgggtctcaagtattgatgagaatggtggaagcacattctacgtagactccgtgaagggccgcttcaccatctccagagacaatttcaggagcacgctgtttctgcaaatgaacagcctgagagccgaggacacggccctctatttctgtgcgaaagtctatagcagtgccccctacgcgcacttctttgacttctggggcaagggaatcctggtcaccgtctcctcagcctccaccaagggcccatcggtcttccccctggcgccctgctccaggagcacctccgagagcacagcggccctgggctgcctggtcaaggactacttccccgaacc

SEQ ID NO: 789697 - DNA, 650 bp, Homo sapiens
  misc_feature: NA.47.2.A02.G47A2.Sanger.heavy.1.sanger
cggtgctcgatttagactcatctacagggaaagggggctctgagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacaccctggggggtccctgagactctcctgtgcagcctctggactcacctttagcaactctgtcatgggctgggtccgccaggctccggggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttccccgaaccggttac

SEQ ID NO: 789698 - DNA, 650 bp, Homo sapiens
  misc_feature: NA.47.46.E02.G47E2.Sanger.heavy.1.sanger
cggtgctcgatttagactcatctacagggaaaggggtctgagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacaccctggggggtccctgagactctcctgtgcagcctctggactcacctttagcaactctgtcatgggctgggtccgccaggctccggggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttccccgaaccggttactg

SEQ ID NO: 789699 - DNA, 498 bp, Homo sapiens
  misc_feature: NA.47.64.F09.G47F9.Sanger.heavy.1.sanger
ggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgatatttggggccaagggacaagggtcaccgtctccgcagcctc

SEQ ID NO: 789700 - DNA, 490 bp, Homo sapiens
  misc_feature: NA.40.67.G01.G40G1.Sanger.heavy.1.sanger
tgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagttttccctgacgctgacgtctgtgaccgccgcagacacggctgtctattattgtgcgagactagccttctgtagtgggggtacttgcaacccgggatactactccaccttcggcttggacatctggggccgaggggcctcggtcgtcgtttcctcagcct

SEQ ID NO: 789701 - DNA, 650 bp, Homo sapiens
  misc_feature: NA.40.81.H04.G40H4.Sanger.heavy.1.sanger
  modified_base (640)..(640): a, c, t, g, unknown or other
gaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccagggaaccctggtcaccgtctcctcagcctccaccaagggcccatcggtcttccccctggcgccctgctccaggagcacctccgagagcacagcggccctgggctgcctggtcaaggactacttccccgaaccggttactgtctcttggaattnccggggccct

SEQ ID NO: 789702 - DNA, 638 bp, Homo sapiens
  misc_feature: NA.41.2.A02.G41A2.Sanger.heavy.1.sanger
cggtgctcgatttagactcatctacaggggagagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcaccatgagtggtgacacggccacgagcacggtccacatggaacttaccagtctgaagtctgaggacacggccgtttacttctgtgcgagaccccgctggaacgggggggcctactacggtctagacgtctggggccaggggaccgcggtcaccgtctcctcagcctccaccaagggcccatcggtcttccccctggcgccctgctccaggagcacctccgagagcacagcggccctgggctgcctggtcaaggactacttccccgaaccggttactgtctcttg

SEQ ID NO: 789703 - DNA, 650 bp, Homo sapiens
  misc_feature: NA.49.26.C04.G49C4.Sanger.heavy.1.sanger
cggtgctcgatttagtctagcgactttgggtttggggagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggtgtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttgaccactgcggccagggaaccctagtcaccgtctcctcagcctccaccaagggcccatcggtcttccccctggcaccctcctccaagagcacctctgggggcacagcggccctgggctgcctggtcaaggactacttccccgaaccggttactgtctctt

SEQ ID NO: 789704 - DNA, 323 bp, Homo sapiens
  misc_feature: NA.49.28.C06.G49C6.Sanger.heavy.1.sanger
gattcaagtattggatattacgcagagtccgtaaagggccgattcaccatctccagagacaattcgaagaacaccatgtatctggaactgagcagagtcacatctgaggacacggctatgtattactgtgtgaaagacttttatgacagtagtggtttctccgagtatgcacattacggcatggacgtctggggccaagggaccccggtcaccgtctccttagcctccaccaagggcccatcggtcttccccctggcaccctcctccaagagcacctctgggggcacagcggccctgggctgcctggtcaaggactacttccc

SEQ ID NO: 789705 - DNA, 323 bp, Homo sapiens; identical to SEQ ID NO: 789704
  misc_feature: NA.49.28.C06.G49C6-2.Sanger.heavy.1.sanger

SEQ ID NO: 789706 - DNA, 650 bp, Homo sapiens
  misc_feature: NA.49.33.C11.G49C11.Sanger.heavy.1.sanger
ggtgctcgatttagagtgagctcgttgggtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaagggcccatcggtcttccccctggcgccctgctccaggagcacctccgagagcacagcggccctgggctgcctggtcaaggactacttccccgaaccggttactgtctcttggaattccggggccctcaccagtggtgtccatacctttcccgcggtgcttcagagttccggtttgtattccctgtcaagtgtcgtgacg

SEQ ID NO: 789707 - DNA, 650 bp, Homo sapiens
  misc_feature: NA.49.5.A05.G49A5.Sanger.heavy.1.sanger
accggtgctcgatttagatagatagacaggggtgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaagggaccaggagtgggtggcagttatatcgtatgatggaaacgaaaaatactacgcagactccgtgaagggccgattcaccatctcccgacacaattccaagaacacattgtttctactgctgaacagcctgagaagtgacgacacggctgtatatcactgtgcggcaggcaacgattactacccgaaggactactggggccagggaacccttgtcatcgtctcctcagcctccaccaagggcccatcggtcttccccctggcaccctcctccaagagcacctctgggggcacagcggccctgggctgcctggtcaaggactacttccccgaaccggttactgtctcttggaaattccgg

SEQ ID NO: 789708 - DNA, 650 bp, Homo sapiens
  misc_feature: NA.49.62.F07.G49F7.Sanger.heavy.1.sanger
  modified_base (648)..(648): a, c, t, g, unknown or other
cggtgctcgatttagtagtcgcacgttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgaacacagcctacatggaactgcgcagcctaggatctgccgacacggccgtatatttctgtgcgagagagatgtctttctatgatagtactagtcattatgctcttgatatttggggccaagggacaatggtcaccgtttcttcagcctccaccaagggcccatcggtcttccccctggcaccctcctccaagagcacctctggtggcacagcggccctgggctgcctggtcaaggactacttccccgaaccggttactgtctcttnaa

SEQ ID NO: 789709 - DNA, 650 bp, Homo sapiens
  misc_feature: NA.49.62.F07.G49F7-2.Sanger.heavy.1.sanger
cggtgctcgatttagtagtcgcacgttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgaacacagcctacatggaactgcgcagcctaggatctgccgacacggccgtatatttctgtgcgagagagatgtctttctatgatagtactagtcattatgctcttgatatttggggccaagggacaatggtcaccgtttcttcagcctccaccaagggcccatcggtcttccccctggcaccctcctccaagagcacctctggtggcacagcggccctgggctgcctggtcaaggactacttccccgaaccggttactgtctcttgga

SEQ ID NO: 789710 - DNA, 650 bp, Homo sapiens
  misc_feature: NA.49.9.A09.G49A9.Sanger.heavy.1.sanger
cgatttagcgagacgcgcagggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccagggaaggggctgatgtgggtctcacgtattgatgttgatgggagttacagtgaccacgcggactctgtgaagggccgattcaccgtctccagagaaaacgccaagaacacggtgtatctgcaaatgactggcctgagagccgaggacacggcagtttattactgtgcaagaggcttgtggtcgactgtcgacctggactggtacttcgatctgtggggccgtggcaccctggtcactgtctcctcggcctccaccaagggcccatcggtcttccccctggcaccctcctccaagagcacctctgggggcacagcggccctgggctgcctggtcaaggactacttccccgaaccggttactgtctcttggaattccggggc

SEQ ID NO: 789711 - DNA, 650 bp, Homo sapiens
  misc_feature: NA.51.12.B01.G51B1.Sanger.heavy.1.sanger
gaccggtgctcgatttagtagtgtagattcgcgggggagcatcacccagcaaccacatctgtcctctagagaaccccctgagagcccctctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaagcggcggacagaggttcgcttactggttcgaggctctcccccagagtcttggactactggggccagggaaccctgatcatcgtctcctcagcctccaccaagggcccatcggtcttccccctggcaccctcctccaagagcacctctgggggcacagcggccctgggctgcctggtcaaggactacttccccgaaccg

SEQ ID NO: 789712 - DNA, 650 bp, Homo sapiens
  misc_feature: NA.51.30.C08.G51C8.Sanger.heavy.1.sanger
ggtgctcgatttagtctgacgtcaaagggaaaggggtctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggagtgggtggcacttatctcatctgatggaaggtctgaatcttatgccgactccgtgaagggccgattcaccatctccagagacaattccaagaatacactatatcttcaaatgaacagtctgagacgtgaagacacggctgtctattactgtgcgactgagatgtcttattacgatgccagtggtttagtaccgttcgacccctggggccagggaaccctggtcaccgtctcctcagcttccaccaagggcccatcggtcttccccctggcgccctgctccaggagcacctctgggggcacagcggccctgggctgcctggtcaaggactacttccccgcgccgg

SEQ ID NO: 789713 - DNA, 650 bp, Homo sapiens
  misc_feature: NA.51.37.D04.G51D41.Sanger.heavy.1.sanger
ccggtgctcgatttagtagcatactgttgggtttggggtctgggagaagagccccagtcccagaattcccaggagtttccattcggtgatcagcactgaacacagaggactcaccatggagtttgggctgagctgggttttccttgttgctactatagaaggtgtccagtgtcaggtgcagctggtggaatctgggggaggcttggtcaagcctggagggtccctgagactctcctgtgcagcctctggattcaccttcagtggctacttcatgagctggatccgccaggctccagggaaggggctgcagtgggtctcacatattagtgctaatgggagaaccacattctacgcagactctgtgaagggccgattctccatctccagggacaacgccaagaactcactgtatctgcaaatgaacagtctaagagccgaagacacggccgtgtacttctgtgcgagtgtgggagaggactacggtgacacggagcctttctcctactacttcggtgtggacgtctggggccaagggaccacggtcaccgtctcctcagcctccaccaagggcccatcggtcttccccctggcaccctcctccaagagcacctctggcggcacagcggccctgggctgcctggtcaaggact

SEQ ID NO: 789714 - DNA, 650 bp, Homo sapiens
  misc_feature: NA.51.40.D07.G51D7.Sanger.heavy.1.sanger
cggtgctcgatttagtgatagagcgtaacaacagagggggggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggaggcgtggtccagcctgggaggtccctgagactctcctgtgtagtctctggattcaccttcagggtgtacgacatgcactgggtccgccaggctccaggcaaggggctggagtgggtggcatttatatcacatgatggaagtaaaacatactatgcagagtccgtgaagggccgattcaccatctccagagacaattccaagaacacactgtttctgcacatgaaaagcctgagagctgaggacacggctgtttattactgtgcgaacttaatcacggaggacaacggtaacccccgtccgctcggtacggacgtctggggccaagggaccacggtcaccgtctcctcagcctccaccaagggcccatcggtcttccccctggcaccctcctccaagagcacctctgggggcacagcggccctgggctgcctggtcaaggactacttccccgaac

SEQ ID NO: 789715 - DNA, 650 bp, Homo sapiens
  misc_feature: NA.51.41.D08.G51D8.Sanger.heavy.1.sanger
gctcgatttagtcacgcgagaaagggaaagggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtacagccagggcggtccctgagactctcctgtacagcctctggattcacctttggtgattatgctatgagctgggtccgccaggctccagggaaggggctggagtgggtaggtttctttagaggcaaagcttatggtgggacaacagaatacgccgcgtctgtgataggccgattcaccatctcaagagatgattccaaaagcatcgcctatctgcacatgagcagcctgaaaaccgaggacacagccgtgtatttctgtactagagtcttcttatattactatgatactagtggttattcaggagtggggcacggtatggacgtctggggccaagggaccacggtcaccgtctcctcagcctccaccaagggcccatcggtcttccccctggcaccctcctccaagagcacctctgggggcacagcggccctgggctgcctggtcaaggac

SEQ ID NO: 789716 - DNA, 650 bp, Homo sapiens; identical to SEQ ID NO: 789715
  misc_feature: NA.51.41.D08.G51D8-2.Sanger.heavy.1.sanger

SEQ ID NO: 789717 - DNA, 650 bp, Homo sapiens
  misc_feature: NA.51.5.A05.G51A5.Sanger.heavy.1.sanger
accggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcacctcgtgtggccccaatttggtttaccggcacacaaaatcagggcaagtcctacgacggtctggacgtctggggccaagggaccacggtcaccgtgtcttcagcctccaccaagggcccatcggtcttccccctggcaccctcctccaagagcacctctgggggcacagcggccctgggctgcctggtcaaggactacttccccgaaccggtgacggt

SEQ ID NO: 789718 - DNA, 650 bp, Homo sapiens
  misc_feature: NA.51.52.E08.G51E8.Sanger.heavy.1.sanger
gtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctgaccgacacggccgtgtatttttgtgtgagagattttcggacaatccagagacccctgtggtcgcgacatgggaatgtcaagaatgaccacgtcttcggcatggacgtctggggccaagggaccacggtctccgtctccccagcctccaccaagggcccatcggtcttccccctggcaccctcctccaagagcacctctgggggcacagcggccctgggctgcctggtcaaggactac

SEQ ID NO: 789719 - DNA, 650 bp, Homo sapiens
  misc_feature: NA.51.76.G10.G51G10.Sanger.heavy.1.sanger
cggtgctcgatttagtcactcatacagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcactgggtccgccaggctccaggcaaggggctggagtgggtggcatttatatcagatgatggcagtaataaagagtatgcagtctccgtgaagggccgattcaccatctccagagacaattcccagaacacactgtatctgcaaatgaacagattgagagctgaggacacggctgtgtatttctgtgcgaaacgctatgagtgggagttaggggtagagtatggtatggacgtctggggacaagggaccacggtcaccgtctcctcagcctccaccaagggcccatcggtcttccccctggcaccctcctccaagagcacctctgggggcacagcggccctgggctgcctggtcaaggactacttccccgaaccggttactgt

SEQ ID NO: 789720 - DNA, 650 bp, Homo sapiens
  misc_feature: NA.51.77.G11.G51G11.Sanger.heavy.1.sanger
cggtgctcgatttagctagtcactcaagggaaaggggctgggagaggagcccagcactagaagtcggcggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatttcatatgatggaagtaaaatattctatgtagactccgtgaagggccgcttcatcatctccagagacaattcccagaacaccctgtttctgcaaatgcacagcctgagacctgaggacacggctgtgtattactgtgcgaacttaatcacggaggacaacggtgacccccgtccgctcggtgtggaggtctggggccaagggaccacggtcatcgtctcctcagcctccaccaagggcccatcggtcttccccctggcaccctcctccaagagcacctctgggggcacagcggccctgggctgcctggtcaaggactacttccccgaac

SEQ ID NO: 789721 - DNA, 650 bp, Homo sapiens
  misc_feature: NA.51.78.H01.G51H1.Sanger.heavy.1.sanger
cggtgctcgatttagtgtgagtagtttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaggggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttccccctggcaccctcctccaagagcacctctgggggcacagcggccctgggctgcctggtcaaggactacttccccgaaccggttactgt

SEQ ID NO: 789722 - DNA, 650 bp, Homo sapiens
  misc_feature: NA.51.82.H05.G51H51.Sanger.heavy.1.sanger
ggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctgaccgacacggccgtgtatttttgtgtgagagattttcggacaatccagagacccctgtggtcgcgacatgggaatgtcaagaatgaccacgtcttcggcatggacgtctggggccaagggaccacggtctccgtctccccagcctccaccaaggcccatcggtcttccccctggcaccctcctccaagagcacctctgggggcacagccgccctgggctgcctggtcaaggactac

SEQ ID NO: 789723 - DNA, 650 bp, Homo sapiens
  misc_feature: NA.52.2.A02.G52A2.Sanger.heavy.1.sanger
cggtgctcgatttagactcatctacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaggtggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaaaatatactatgtagactccgtgaagggccgattcatcatctccagagacaattccgagaacaccctgtatctgcaaatgaacagcctgagagctgaggacacggctgtgtattactgtgcgaacttaatcacggaggacaacggtggcccccgtccgctcggtgcggaggtctggggccaagggaccacggtcaccgtctcctcagcctccaccaagggcccatcggtcttccccctggcaccctcctccaagagcacctctgggggcacagcggccctgggctgcctggtcaaggactacttccccgaaccggttac

SEQ ID NO: 789724 - DNA, 650 bp, Homo sapiens
  misc_feature: NA.52.37.D04.G52D4.Sanger.heavy.1.sanger
cggtgctcgatttagtcactcatacagggggggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggaggcgtggtccagcctgggaggtccctgagactctcctgtgcaggctctgcatttcccttcaataactatgctatcgattgggtccgccaggctccaggcaagggactggagtgggtggcagtaatatcagctgatggaggcactaaatattacgcagattctgcgaggggccgattcaccatatccagagacaactcccaagatatgatatatctacaaatgaacagcctgagacctgaggacacggctgtatattactgtgcgtcagggggcagtgcctggccacgtgatgcttttgatttctggggccaagggacattcgtcaccgtctcctcagcctccaccaagggcccatcggtcttccccctggcaccctcctccaagagcacctctgggggcacagcggccctgggctgcctggtcaaggactacttccccgaaccggttactgtctcttggaatt

SEQ ID NO: 789725 - DNA, 650 bp, Homo sapiens
  misc_feature: NA.52.81.H04.G52H4.Sanger.heavy.1.sanger
gaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcagtcggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccgcttcaccatctccagagacaattccaagaacacactgtatctgcaaatgaacagcctgagagccgaggacacggccacctatttctgtacgaaagaatacacacagctggacgaggagccaaacggcgactacttctttgactactggggccagggaaccctggtcaccgtctcctcagcctccaccaagggcccatcggtcttccccctggcaccctcctccaagagcacctctgggggcacagcggccctgggctgcctggtcaaggactacttccccg

SEQ ID NO: 789726 - DNA, 650 bp, Homo sapiens
  misc_feature: NA.53.73.G07.G53G7.Sanger.heavy.1.sanger
ggtgctcgatttagctctacgctcaggggatcatccaacaaccacatcccttctctacagaagcctctgagaggaaagttcttcaccatggactggacctggagggtcttctgcttgctggcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgagtggatgggtctaatcaaccctagtggtggatctacaagttactcacagagaatgcagggccgaattaccatgaccagagacacgtccacgagtacagtctacatggaggtgagcagcctgagatctgaggacacggccatgtattactgtgcgatcttagtggattacgactacaatattttgtcagcccagagggactttgacacctggggccagggaaccctggtcaccgtctcctcagcctccaccaagggcccatcggtcttccccctggcaccctcctccaagagcacctctgggggcacagcggccctgggctgcctggtcaaggactacttccccgaaccggttactgtctcttggaattc

SEQ ID NO: 789727 - DNA, 650 bp, Homo sapiens
  misc_feature: NA.17.25.C03.K17C3.Sanger.light.1.sanger
  modified_base (600)..(600): a, c, t, g, unknown or other
  modified_base (628)..(628): a, c, t, g, unknown or other
gaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactccgcaacctgaggattgtgcaatctactactgtcaacagagttacagttcccctcgcacttttggccaggggaccaaagttgagatcaaacgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcanggaattcccaggagtcggtcaccgaacngacagcaaggactcaacctact

SEQ ID NO: 789728 - DNA, 650 bp, Homo sapiens
  misc_feature: NA.3.70.G04.K3G4.Sanger.light.1.sanger
  modified_base (623)..(623): a, c, t, g, unknown or other
cggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccacttagcctggtaccagcagaaacctggccagcctcccagtctcctcatctatggagcacacaacagggccactggcatcccagccaggttcagtggcagtgggtctgggacagacttcaccctcatcatcagccgcctagagcctgaagattttgcagtttattactgtcagcagggttacttctggcccactttcggccctgggaccaaagtggatatcaaacgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcagggaattcccaggagtcggtcaccgaacngacagcaaggactcaacctactctctg

SEQ ID NO: 789729 - DNA, 650 bp, Homo sapiens
  misc_feature: NA.4.26.C04.K4C4.Sanger.light.1.sanger
  modified_base (578)..(578): a, c, t, g, unknown or other
cggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaactgtggctgcaccatctgtcttcatcttcccgccatctgatgagcagttgaaatctggaactgcctctgttgtgtgcctgctgaataacttctatccccgggaggctaangtacagtggaaggtggacaacgccctccaatcagggaattcccaggagtcggtcaccgaacagacagcaagg

SEQ ID NO: 789730 - DNA, 109 bp, Homo sapiens
  misc_feature: NA.8.19.B08.K8B8.Sanger.light.1.sanger
  modified_base (76)..(76): a, c, t, g, unknown or other
cggtgctcgatttagtgagtcagtaagggggaggaactgctcagttaggacccagagggaaccatggaagccccanctcagcttctcttcctcctgctactctggctcc

SEQ ID NO: 789731 - DNA, 638 bp, Homo sapiens
  misc_feature: NA.8.33.C11.K8C11.Sanger.light.1.sanger
  modified_base (587)..(587): a, c, t, g, unknown or other
  modified_base (608)..(608): a, c, t, g, unknown or other
ggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaactgtggctgcaccatctgtcttcatcttcccgccatctgatgagcagttgaaatctggaactgcctctgttgtgtgcctgctgaataacttctatccccgggaggctaaggtacagtggangtggacaacgccctccaatcnggaattcccaggagtcggtcaccgaacaga

SEQ ID NO: 789732 - DNA, 650 bp, Homo sapiens
  misc_feature: NA.8.38.D05.K8D5.Sanger.light.1.sanger
  modified_base (608)..(608): a, c, t, g, unknown or other
gaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcanggaattcccaggagtcggtcaccgaacaggacagcaaggact

SEQ ID NO: 789733 - DNA, 650 bp, Homo sapiens
  misc_feature: NA.8.39.D06.K8D6.Sanger.light.1.sanger
  modified_base (556)..(556): a, c, t, g, unknown or other
gtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgccatctgatgagcagttgaaatctggaactgcctctgttgtgtgcctgctgaataacttctatccccgggaggctaangtacagtggaaggtggacaacgccctccaatcagggaattcccaggagtcggtcaccgaacaggacagcaaggactcaacctactctctgtcat

SEQ ID NO: 789734 - DNA, 650 bp, Homo sapiens
  misc_feature: NA.8.39.D06.K8D6-2.Sanger.light.1.sanger
  modified_base (556)..(556): a, c, t, g, unknown or other
  modified_base (590)..(590): a, c, t, g, unknown or other
gtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgccatctgatgagcagttgaaatctggaactgcctctgttgtgtgcctgctgaataacttctatccccgggaggctaangtacagtggaaggtggacaacgccctccaatcanggaattcccaggagtcggtcaccgaacaggacagcaaggactcaacctactctctgtcat

SEQ ID NO: 789735 - DNA, 650 bp, Homo sapiens
  misc_feature: NA.8.42.D09.L8D9.Sanger.light.1.sanger
ggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccgccctcctctgaggagcttcaagccaacaaggccacactggtgtgtctcataagtgacttctatcccggggcggtgaccgtggcttggaaggccgactcgagcccagtgaaaggccggagtggaaactacaaccccttccaaacagtcaaacaataaatacgcc

SEQ ID NO: 789736 - DNA, 650 bp, Homo sapiens
  misc_feature: NA.9.1.A01.L9A1.Sanger.light.1.sanger
  modified_base (589)..(589): a, c, t, g, unknown or other
ggtgctcgatttagacgtctcatcaaggaaggaaggggggggtctcaggaggcagcgctctcgggacgtctccaccatggcctgggctctgctattcctcaccctcctcactcagggcacagggtcttgggcccagtctgccctgactcagcctgcctccgtgtctgggtctcctggacagtcgatagccatctcctgcactggaactaacagtgacgttggtgcttataattatgtctcctggtatcaacaacacccaggcaaagccccccaactcattatttctgatgtcaacaatcggcccccagggatttctgatcgcttctctggctccaagtctggcaacacggcctccctgaccatctctgggctccgggctgaggacgaggctcactattactgcagctcatatacaaccagcgacactctgttgttcggcggagggactgaactgaccgtcctaggtcagcccaaggctgccccctcggtcactctgttcccgccctcctctgaggagcttcaagccaacaaggccacactggtgtgcctcatcagtgacttctatcccggggcggtgaccgtggcttgnaaggccgactcgagcccagtgaaaggccggagtggaaactacaaccccttccaaacagtca

SEQ ID NO: 789737 - DNA, 613 bp, Homo sapiens
  misc_feature: NA.9.12.B01.L9B1.Sanger.light.1.sanger
  modified_base (584)..(584): a, c, t, g, unknown or other
gaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggaccacggtcaccgtcctaggtcagcccaaggccaaccccactgtcactctgttcccgccctcctctgaggagctccaagccaacaaggccacactggtgtgcctcatcagtgacttctatcccggggcggtgaccgtggcttgnaaggccgactcgagcccagtgaagccgga

SEQ ID NO: 789738 - DNA, 650 bp, Homo sapiens
  misc_feature: NA.9.31.C09.L9C9.Sanger.light.1.sanger
ggtgctcgatttagacgtctccaccatggcctgggctctgctattcctcaccctcctcactcagggcacagggtcttgggcccagtctgccctgactcagcctgcctccgtgtctgggtctcctggacagtcgatagccatctcctgcactggaactaacagtgacgttggtgcttataattatgtctcctggtatcaacaacacccaggcaaagccccccaactcattatttctgatgtcaacaatcggcccccagggatttctgatcgcttctctggctccaagtctggcaacacggcctccctgaccatctctgggctccgggctgaggacgaggctcactattactgcagctcatatacaaccagcgacactctgttgttcggcggagggactgaactgaccgtcctaggtcagcccaaggctgccccctcggtcactctgttcccgccctcctctgaggagcttcaagccaacaaggccacactggtgtgtctcatcagtgacttctatcccggggcggtgaccgtggcttggaaggccgactcgagcccagtgaaggccggagtggaaactacaaccccttccaaacagtcaaacaataaatacgccgctagcagctatctctctctcaccccagaacagtgga

SEQ ID NO: 789739 - DNA, 549 bp, Homo sapiens
  misc_feature: NA.9.34.D01.L9D1.Sanger.light.1.sanger
gacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccgccctcctctgaggagctccaagccaacaaggccacactggtgtgcctcatcagtgacttctatcccggggcggtgaccgtggcttggaaggccgactcgagcccagtgaaggccggagtggaaactacaaccccttccaaacagtcaaacaataaatacgccgctagcagctatctctctctcaccccagaacagtggaaatcccacaggtcctattcttgccaggtcacacacgaggggtcaaccgttgagaagactgttgccccaacagagtgcagctgatcataatcagccataccacatttgtagaggttttacttgctttaaaaa

SEQ ID NO: 789740 - DNA, 650 bp, Homo sapiens
  misc_feature: NA.10.1.A01.L10A1.Sanger.light.1.sanger
ggtctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtcagcccaaggctgccccctcggtcactctgttcccaccctcctctgaggagcttcaagccaacaaggccacactggtgtgtctgatcagtgacttctatcccggggcggtgaccgtggcttggaaggccgactcgagcccagtgaaaggccggagtggaaactacaaccccttccaaacagtcaaacaata

SEQ ID NO: 789741 - DNA, 650 bp, Homo sapiens
  misc_feature: NA.10.35.D02.K10D2.Sanger.light.1.sanger
  modified_base (564)..(564): a, c, t, g, unknown or other
  modified_base (598)..(598): a, c, t, g, unknown or other
ggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccatctgtcttcatcttcccgccatctgatgagcagttgaaatctggaactgcctctgttgtgtgcctgctgaataacttctatccccgggaggctaangtacagtggaaggtggacaacgccctccaatcanggaattcccaggagtcggtcaccgaacaggacagcaaggactcaacctactc

SEQ ID NO: 789742 - DNA, 650 bp, Homo sapiens
  misc_feature: NA.10.38.D05.L10D5.Sanger.light.1.sanger
gaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccgccctcctctgaggagcttcaagccaacaaggccacactggtgtgcctcatcagtgacttctatcccggggcggtgaccgtggcttggaaggccgactcgagcccagtgaaggccggagtggaaactacaaccccttccaaacagtcaaa

SEQ ID NO: 789743 - DNA, 650 bp, Homo sapiens
  misc_feature: NA.10.53.E09.K10E9.Sanger.light.1.sanger
cggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaaacgaactgtggctgcaccatctgtcttcatcttcccgccatctgatgagcagttgaaatctggaactgcctctgttgtgtgcctgctgaataacttctatccccgggaggctaaagtacagtggaagtggacaacgccctccaatcaggaaattcccaggagtcggtcaccgaacaggacagcaaggact

SEQ ID NO: 789744 - DNA, 650 bp, Homo sapiens
  misc_feature: NA.10.6.A06.L10A6.Sanger.light.1.sanger
cggtgctcgatttagatctactgacaacacacaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcataattcatgatgtcaataatcggccctcaggggtttctaatcgcttctctggcttcaagtctggcaacacggcctccctgaccatctctgggctccaggctgaggacgaggctgattattactgcagctcatatacaaccagcagcactcgggtgttcggcggagggaccaagctgaccgtcctaggtcagcccaaggctgccccctcggtcactctgttcccaccctcctctgaggagcttcaagccaacaaggccacactggtgtgcctcatcagtgacttctatcccggggcggtgaccgtggcttggaaggccgactcgagcccagtgaaggccggagtggaaactacaaccccttccaaacagtcaa

SEQ ID NO: 789745 - DNA, 650 bp, Homo sapiens
  misc_feature: NA.10.71.G05.K10G5.Sanger.light.1.sanger
gctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcagggaattcccaggagtcggtcaccgaacaggacagcaaggactcaaccta

SEQ ID NO: 789746 - DNA, 511 bp, Homo sapiens
  misc_feature: NA.10.9.A09.K10A9.Sanger.light.1.sanger
cgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaagtggagatcaaacgaactgtggctgcaccatctgtcttcatcttcccgccatctgatgagcagttgaaatctgg

SEQ ID NO: 789747 - DNA, 631 bp, Homo sapiens
  misc_feature: NA.11.71.G05.K11G5.Sanger.light.1.sanger
  modified_base (558)..(558): a, c, t, g, unknown or other
gctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcatcttcccgccatctgatgagcagttgaaatctggaactgcctctgttgtgtgcctgctgaataacttctatccccgggaggctaangtacagtggaaagtggacaacgccctccaatcaggaaattcccaggagtcggtcaccgaacaggacagcaagg

SEQ ID NO: 789748 - DNA, 650 bp, Homo sapiens
  misc_feature: NA.13.21.B10.L13B10.Sanger.light.1.sanger
gctcgatttagtgtcgtcgcaagagagagaggggggggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataccaagcggccctcagggatccctgagcgattctctggctccaactctgggaacacagccactctgaccatcagcgggacccaggctgtggatgaggctgactattactgtcaggcgtgggacagcagcactgcctccttcggaactgggaccaaggtcaccgtcctaggtcagcccaaggccaaccccactgtcactctgttcccgccctcctctgaggagctccaagccaacaaggccacactagtgtgcctgatcagtgacttctatcccggggcggtgaccgtggcttggaaggccgactcgagcccagtgaaaggccggagtggaaactacaaccccttccaaacagtcaaacaataaatacgccgctagcagctatctctctctcaccc

SEQ ID NO: 789749 - DNA, 650 bp, Homo sapiens
  misc_feature: NA.13.71.G05.L13G5.Sanger.light.1.sanger
gctcgatttagtgtcgtcgcaagagagagggggggggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataccaagcggccctcagggatccctgagcgattctctggctccaactctgggaacacagccactctgaccatcagcgggacccaggctgtggatgaggctgactattactgtcaggcgtgggacagcagcactgcctccttcggaactgggaccaaggtcaccgtcctaggtcaccccaaggccaaccccactgtcactctgttcccgccctcctctgaggagctccaagccaacaaggccacactagtgtgcctcatcagtgacttctatcccggggcggtgaccgtggcttggaaggccgactcgagcccagtgaaaggccggagtggaaactacaaccccttccaaacagtcaaacaataaatacgccgctagcagctatctctctctcacccc

SEQ ID NO: 789750 - DNA, 650 bp, Homo sapiens
  misc_feature: NA.22.29.C07.K22C7.Sanger.light.1.sanger
  modified_base (596)..(596): a, c, t, g, unknown or other
ggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaagggaccaaggtggaagtcaaacgaactgtggctgcaccatctgtcttcatcttcccgccatctgatgagcagttgaaatctggaactgcctctgttgtgtgcctgctgaataacttctatccccgggaggctaaagtacagtggaaaggtggacaacgccctccaatcnggaattcccaggagtcggtcaccgaacaggacagcaaggactcaacctactctc

SEQ ID NO: 789751 - DNA, 608 bp, Homo sapiens
  misc_feature: NA.26.12.B01.K26B1.Sanger.light.1.sanger
  modified_base (562)..(562): a, c, t, g, unknown or other
  modified_base (595)..(595): a, c, t, g, unknown or other
gaccggtgctcgatttagtagtgtagattccgcgggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcggggggaccaagctggagatcaaccgaactgtggctgcaccatctgtcttcatcttcccgccatctgatgagcagttgaaatctggaactgcctctgttgtgtgcctgctgaataacttctatccccgggaggctaangtacagtggaaagtggacaacgccctccaatcnggaattcccagga

SEQ ID NO: 789752 - DNA, 650 bp, Homo sapiens
  misc_feature: NA.26.60.F05.K26F5.Sanger.light.1.sanger
  modified_base (563)..(563): a, c, t, g, unknown or other
  modified_base (601)..(601): a, c, t, g, unknown or other
cggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccatctgtcttcatcttcccgccatctgatgagcagttgaaatctggaactgcctctgttgtgtgcctgctgaataacttctatccccgggaggctaangtacagtggaaggtggacaacgccctccaatcaggaanttcccaggagtcggtcaccgaacaggacagcaaggactcaacctactct

SEQ ID NO: 789753 - DNA, 603 bp, Homo sapiens
  misc_feature: NA.26.78.H01.K26H1.Sanger.light.1.sanger
  modified_base (565)..(565): a, c, t, g, unknown or other
  modified_base (599)..(599): a, c, t, g, unknown or other
cggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtcttcatcttcccgccatctgatgagcagttgaaatctggaactgcctctgttgtgtgcctgctgaataacttctatccccgggaggctaangtacagtggaaaggtggacaacgccctccaatcnggaa

SEQ ID NO: 789754 - DNA, 650 bp, Homo sapiens
  misc_feature: NA.47.2.A02.K47A2.Sanger.light.1.sanger
cggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccatctgtcttcatcttcccgccatctgatgagcagttgaaatctggaactgcctctgttgtgtgcctgctgaataacttctatccccgggaggctaaagtacagtggaaaggtggacaacgccctccaatcaggaaattcccaggagtcggtcaccgaacaggacagcaaggactcaacctact

SEQ ID NO: 789755 - DNA, 614 bp, Homo sapiens
  misc_feature: NA.47.46.E02.K47E2.Sanger.light.1.sanger
cggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccatctgtcttcatcttcccgccatctgatgagcagttgaaatctggaactgcctctgttgtgtgcctgctgaataacttctatccccgggaggctaaagtacagtggaaaggtggacaacgccctccaatcaggaaattcccaggagt

SEQ ID NO: 789756 - DNA, 593 bp, Homo sapiens
  misc_feature: NA.47.64.F09.K47F9.Sanger.light.1.sanger
ggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgtcttcatcttcccgccatctgatgagcagttgaaatctggaactgcctctgttgtgtgcctgctgaataacttctatccccgggaggctaaagtacagtggaaagtggacaacgccctccaatca

SEQ ID NO: 789757 - DNA, 650 bp, Homo sapiens
  misc_feature: NA.40.39.D06.K40D6.Sanger.light.1.sanger
  modified_base (600)..(600): a, c, t, g, unknown or other
gtgctcgatttagtgacatctcgcagttctttggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcanggaattcccaggagtcggtcaccgaacaggacagcaaggactcaacctac

SEQ ID NO: 789758 - DNA, 650 bp, Homo sapiens
  misc_feature: NA.49.26.C04.L49C4.Sanger.light.1.sanger
cggtgctcgatttagtctagcgactttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattccgcggagggaccaagctgaccgtcctaggtcagcccaaggctgccccctcggtcactctgttcccgccctcctctgaggagcttcaagccaacaaggccacactagtgtgcctgataagtgacttctatcccggggcggtgaccgtggcttggaaggccgactcgagcccagtgaaggccggagtggaaactacaaccccttccaaacagtcaaacaataa

SEQ ID NO: 789759 - DNA, 650 bp, Homo sapiens
  misc_feature: NA.49.28.C06.K49C6.Sanger.light.1.sanger
ggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggccaggggaccaagctggagatcaagcgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcagggaattcccaggagtcggtcaccgaacaggacagcaaggactcaacctactctct

SEQ ID NO: 789760 - DNA, 650 bp, Homo sapiens
  misc_feature: NA.49.33.C11.K49C11.Sanger.light.1.sanger
  modified_base (551)..(551): a, c, t, g, unknown or other
ggtgctcgatttagagtagtgatcaggggcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcggggggaccaaggtggagatcaagcgaactgtggctgcaccatctgtcttcatcttcccgccatctgatgagcagttgaaatctggaactgcctctgttgtgtgcctgctgaataacttctatccccgggaggctaangtacagtggaaggtggacaacgccctccaatcagggaattcccaggagtcggtcaccgaacagacagcaaggactcaacctactctctgtcatccactc

SEQ ID NO: 789761 - DNA, 650 bp, Homo sapiens
  misc_feature: NA.49.66.F11.K49F11.Sanger.light.1.sanger
  modified_base (584)..(584): a, c, t, g, unknown or other
gctcgatttagtcacgcgagaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcanggaattcccaggagtcggtcaccgaacaggacagcaaggactcaacctactctctgtcatccactc

SEQ ID NO: 789762 - DNA, 650 bp, Homo sapiens
  misc_feature: NA.49.9.A09.L49A9.Sanger.light.1.sanger
cgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggccaccctgaccgtcagcagggtcgaagccggggatgaggccgactatatctgtcaggtgtgggatagtagtagtgctcttccgggggtgttcggcggagggaccaagttgaccgtcgttggtcagcccaaggctgccccctcggtcactctgttcccgccctcctctgaggagcttcaagccaaccaggccacactagtgtgcctgataagtgacttctatcccggggcggtgaccgtggcttggaaggccgactcgagcccagtgaaggccggagtggaaactacaaccccttccaaacagtcaaacaataaatacgccgctag

SEQ ID NO: 789763 - DNA, 650 bp, Homo sapiens
  misc_feature: NA.51.12.B01.L51B1.Sanger.light.1.sanger
gaccggtgctcgatttagtagtgtagattcgcggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctgttcccgccctcctctgaggagctccaagccaacaaggccacactggtgtgcctcatcagtgacttctatcccggggcggtgaccgtggcttggaaggccgactcgagcccagtgaaagccggagtggaaactacaaccccttccaaacagtcaaacaataaatacg

SEQ ID NO: 789764 - DNA, 650 bp, Homo sapiens
  misc_feature: NA.51.40.D07.K51D7.Sanger.light.1.sanger
  modified_base (600)..(600): a, c, t, g, unknown or other
cggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacaggggtcccatcaaggttcagtggaagtggttctgggacagattttactttcaccatcagcagccttcaccctgaagatcttgcaacatattactgtcaacagtatgataatctcccactcactttcggcggagggaccaaggtggagatcaaacgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcanggaattcccaggagtcggtcaccgaacaggacagcaaggactcaacctac

SEQ ID NO: 789765 - DNA, 650 bp, Homo sapiens
  misc_feature: NA.51.41.D08.K51D8.Sanger.light.1.sanger
  modified_base (621)..(621): a, c, t, g, unknown or other
gctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggagggaccaaggtggagatcaaacgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcagggaattcccaggagtcggtcaccgaacngacagcaaggactcaacctactctctgtc

SEQ ID NO: 789766 - DNA, 650 bp, Homo sapiens
  misc_feature: NA.51.41.D08.K51D8-2.Sanger.light.1.sanger
gctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggagggaccaaggtggagatcaaacgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcaggaaattcccaggagtcggtcaccgaacaggacagcaaggactcaacctactctctgt

SEQ ID NO: 789767 - DNA, 650 bp, Homo sapiens
  misc_feature: NA.51.5.A05.L51A5.Sanger.light.1.sanger
accggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcggcggagggacgaagctgaccgtcctgagtcagcccaaggctgccccctcggtcactctgttcccgccctcctctgaggagcttcaagccaacagggccacactggtgtgcctcatcagtgacttctatcccggggcggtgaccgtggcttggaaggccgactcgagcccagtgaaggccggagtggaaactacaaccccttccaaacagtcaaacaataaatacgccg

SEQ ID NO: 789768 - DNA, 650 bp, Homo sapiens
  misc_feature: NA.51.53.E09.L51E9b.Sanger.light.1.sanger
  modified_base (611)..(611): a, c, t, g, unknown or other
cggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtcactctgttcccgccctcctctgaggagcttcaagccaacaaggccacactggtgtgcctcatcagtgacttctacccggggcggtgaccgtggcttggaaggccgactcgagcccagtgaangccggagtggaaactacaaccccttccaaacagtcaaac

SEQ ID NO: 789769 - DNA, 650 bp, Homo sapiens
  misc_feature: NA.51.76.G10.K51G10.Sanger.light.1.sanger
cggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcagggaattcccaggagtcggtcaccgaacaggacagcaaggactcaacctactctct

SEQ ID NO: 789770 - DNA, 464 bp, Homo sapiens
  misc_feature: NA.51.77.G11.K51G11.Sanger.light.1.sanger
cggtgctcgatttagctagtcactcaagggaaagggggcaggagtcagtcccaaccaggacacagcatggacatgagggtccctgctcagctcctggggctcctgctgctctggctctcaggtggcagatgtatcatccagatgacccagtctccatcctccctgtctgcatatataggagacagaatcaccatcacttgccgggcgagtcaggacattagcgtatatttgaattggtatcagcaaaaaccagggaaagcccctgagctcctgatcctcgatgcatccactttggaaacaggggtcccatcaaggttcagtggaagtggctctgggacacattttactttcaccatcagcagactgcagcctgaagatgttgcaacatattactgtcaacagtatcataatctcccgctcactttcggcggagggaccaaggtggagatcaaacgaactgtggc

SEQ ID NO: 789771 - DNA, 650 bp, Homo sapiens
  misc_feature: NA.51.78.H01.K51H1.Sanger.light.1.sanger
cggtgctcgatttagtgtgagtagtttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtacccctcagctcactttcggcggagggaccaaggtggagatcaaacgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcagggaattcccaggagtcggtcaccgaacaggacagcaaggactcaaccta

SEQ ID NO: 789772 - DNA, 650 bp, Homo sapiens
  misc_feature: NA.51.82.H05.L51H51.Sanger.light.1.sanger
ggtgctcgatttagtcgagctctcagagagaaagggggtaggctcaggaggcagagctctgattgtctcaccatggcctggatccctctcctgctccccctcctcattctctgcacagtctctgtggcctcctatgagctgacacagccatactcagtgtcagtgtctccgggacagacagccaggatcacctgctcaggagatgtactgggaaaaaaatatgctcgttggttccagcagaaggcgggccaggcccctgtcttgatgatttataaagacactgagcggccctcagggatccctgagcgattctccggctccagctcagggactacagtcaccttgaccatcagcggggcccaggttgacgatgaggctgactattactgttactctgcggctgacaacaattctgggatattcggcggagggaccaagctgaccgtcttaggtcagcccaaggctgccccctcggtcactctgttcccaccctcctctgaggagcttcaagccaacaaggccacactggtgtgcctcataagtgacttctatcccggggcggtgaccgtggcttggaaggccgactcgagcccagtgaaaggccggagtggaaactacaaccccttccaaacagtcaaacaataaatacg

SEQ ID NO: 789773 - DNA, 146 bp, Homo sapiens
  misc_feature: NA.51.82.H05.L51H51-2.Sanger.light.1.sanger
ggtgctcgatttagtcgagctctcaaagagaaagggggtaggctcaggaggcagagctctgattgtctcaccatggcctggatccctctcctgctccccctcctcattctctgcacagtctctgtggcctcctatgagctgacaca

SEQ ID NO: 789774 - DNA, 650 bp, Homo sapiens
  misc_feature: NA.52.2.A02.K52A2.Sanger.light.1.sanger
  modified_base (556)..(556): a, c, t, g, unknown or other
  modified_base (590)..(590): a, c, t, g, unknown or other
cggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaactgtggctgcaccatctgtcttcatcttcccgccatctgatgagcagttgaaatctggaactgcctctgttgtgtgcctgctgaataacttctatccccgggaggctaangtacagtggaaggtggacaacgccctccaatcanggaattcccaggagtcggtcaccgaacaggacagcaaggactcaacctactctctgtcat

SEQ ID NO: 789775 - DNA, 650 bp, Homo sapiens
  misc_feature: NA.52.37.D04.L52D4.Sanger.light.1.sanger
ccggtgctcgatttagtagcatactgttgggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtcactctgttcccgccctcctctgaggagcttcaagccaacaaggccacactggtgtgcctcatcagtgacttctatcccggggcggtgaccgtggcttggaaggccgactcgagcccagtgaaggccggagtggaaactacaaccccttccaaacagtc

SEQ ID NO: 789776 - DNA, 650 bp, Homo sapiens
  misc_feature: NA.52.76.G10.L52G10.Sanger.light.1.sanger
cggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatacacaaacagaaacacttgggtgttcggcggcgggaccaaactgaccgtcctacgtcagcccaaggctgccccctcggtcactctgttcccgccctcctctgaggagcttcaagccaacaaggccacactagtgtgcctcatcagtgacttctatcccggggcggtgaccgtggcttggaaggccgactcgagcccagtgaaggccggagtggaaactacaaccccttccaaacagtcaaacaataaat

SEQ ID NO: 789777 - DNA, 650 bp, Homo sapiens
  misc_feature: NA.53.65.F10.L53F10.Sanger.light.1.sanger
cggtgctcgatttagctacgctctaaggggagtctgggcctaaggaagcagcactggtggtgcctcagccatggcctggaccgttctcctcctcggcctcctctctcactgcacagactctgtgacctcctatgtgctgactcagccaacctcggtgtcagtggccccaggacagacggccagcattacctgtgggggaaaccacattggagctaaaaatgtgcactggtaccagcagaagccaggccaggcccctgtgctggtcgtctataatggaagcggccggccctcatggatccctgggcgattctctggctccaagtctgggaacacggccaccctaaccatcagcagggtcgaagccggggatgaggccgactattactgtcaggtgtgggataatagtaatggtgggaattgggtgttcggcggagggaccaagctgaccgtcctaggtcagcccaaggctgccccctcggtcactctgttcccgccctcctctgaggagcttcaagccaacaaggccacactggtgtgcctcataagtgacttctatcccggggcggtgaccgtggcttggaaggccgactcgagcccagtgaaggccggagtggaaactacaaccccttccaaacagtcaaacaataaat

SEQ ID NO: 789778 - DNA, 719 bp, Homo sapiens
  misc_feature: 4.44.55.E11.1.pb.heavy.1.raw 4
ctatgcgccttgccagcccgctcagacagtatataggaagtagtccttgaccaggcagccagggccgctgtgcccccagaggtgctcttggaggagggtgccagggggaagaccgatgggcccttggtggaggcggaggcgacggtgaccagggttccctgggcccagaagtcaaacgaataataaccactccgagcgccgacttgtcttcgcacagtaatagacggccgtgtcgtcgcctctcaggttgttcatttgaagataaaaccgtgttcctgggaattgtccctggagatggtgaatcggcccttcacggagtctgcgtagtatgtgaaatcaccagtataaatgactgagacccactccaggcccttcctggagcctggcggacccaactcatgtagttgcttgctgacggtgagcccagaggctggcacaggagagtctctgggaccccccaggctggactaagcctcctccagactcatcaagccgcaccgtcacactggacaccttttaaaagtccaacaaaggagaaccccagctcagccaaaactccatggtgagtcctctgtgtttcagtgctgatcaccgaatggaaacaccctcggaatcccagtgctgggctcctctcccccccccaaacccaaacgtgcgagtgctaaatcgagcaccggtcgtgtatatactgtctgaatggcgcgagggagggcgatacg

SEQ ID NO: 789779 - DNA, 634 bp, Homo sapiens
  misc_feature: 16.44.86.H09.1.pb.heavy.1.raw 16
ctatgcgccttgcagcccgctcaacagtatataggaagtagtccttgaccaggcagcccagggccgctgtgcccccagggtgctcctggagcagggcgccagggggaagaccgatgggcccttggtggaagctgaggagacagtgaccagggtgcacggccccatgattgaaagacagtctcgcctcgcacagaaataaacggccgtgtcccggcggtcacggaggtcagtttcagggagaagccggtttcatggacggtccctcgaaatggtgagacgactcttgaggacggagagtacgtcgcccagtataatggatgtcaccaatccactccattcctccctggggctgcccgatccagcccaagaatgatcagaactgatggaaactccagagacagtgcagatgagagacagggttccgaaggcctcaccagtcctggcccgactcctgcagctgcacctgggacaggacccatctgggagctgccaccagcagaggaaaaaccacaggtgcttcatgtttgcacaggagggtccttgactctcagaagcatccccaaacccaagtctatagcactaatcgagcaccggtcgtgtatatactgtctgatgcgcgagggaggcgaatacg

SEQ ID NO: 789780 - DNA, 695 bp, Homo sapiens
  misc_feature: 21.44.74.G08.1.pb.heavy.1.raw 21
ctatgcgccttgccagcccgctcagacagtatataggaagtagtccttgaccaggcagcccagggccgctggtgccccagaggtggctctggagcagggcgccaggggaagaccgatgggcccttggtggaagctgaggggacaatgaccagggttccctgcccccagatctcaaaggctccatgcgagctggggtacggacctctcgcaccagtagtagacggccgtgtcgtcggatttcaaagaactcattgtcatggagactgtgtctgtggacttgtccgcggtaatcgtaaattctgccccggaagtctcgtgcgtaggtgagtgagcccaaaaagagggatgattccacccatccactcaagcccttgtccaggggcctggcgcacccagttgatggtataagtagtggaactggtagtacttccagaggccgtgcaggaaagggtcaccgaggacccaaggttgcggcattctagtcccagactgcaccagttgcaccagggactgggacacctgttgctgctgccaccacaaagaggaacctccaggtccgtccatggtgatgagctgtgctccaggggcttcttagaggaggaatgtggttgttatgtgatgctccccctgatagagctactaaatcgagcaccggtcgtgtatatactgtctgatggcgcgagggaggcgatacg

SEQ ID NO: 789781 - DNA, 710 bp, Homo sapiens
  misc_feature: 28.44.36.D03.1.pb.heavy.1.raw 28
ctatgcgccttgccagcccgctcagacagtatataggaagtagttccttgaccaggcagccagggccgctgtgctctcggaggtgctcctggagcagggcgccagggggaagaccgatgggcccttggtggaggctgaggagacggtgaccagggttccccggccccagtagtcaaaaccagccactgaccaagtggccgatctctcgaaacagaagtagacagccgtgtcctcgtctctcaggctgtttcattccagatacagtgagttcttggcattgtccctggaattggtgaatcggcccttcacagagtctgcgtagtaggtggtatctccagcaatattaacatatgaaacccactccagccccttccctggagcctggcggacccagttcatggcatagtcactgaagatgaatccagaggctgcaacggagagtctcagggacccccgctgtaccaagcctcccccagactccaccagccgcacctcacagtggacaccttctaaaatagcaacaaggaaaacccagcgcaagcccccaactccatggtgagtcctctgtgttcattgcgatcaccaagtgaaatgccttggaatccaggggctaaaggcacctctctgagagctccaagagagatcgtgacgcagctaaatcgagcaccggtcgtgtatatactgtctgatggcgcgagggaggcgatacg

SEQ ID NO: 789782 - DNA, 682 bp, Homo sapiens
  misc_feature: 52.44.73.G07.1.pb.heavy.1.raw 52
cgtatcgcctccctcgcgccatcagacagtaatatacacgaccggtgctcgattttagctctacgctcagggggggagacgagcccagcactggaagtcgccggtgttttccattcgggatcatcactgaacacagaggactccaccatggactttgggctgagatgggttttcctcgttgctcttttaagaggtggccagtgtcaggtgcagctagtggagtctgggggaggagcggcccagcctgggaactccctgagactctcctgtgcagcctctggattcatcttcaggacctatgccatgcactgggtccgccaggctccaggcaaggggctggagtgggtggcaatttatatcagaagatggaattgaagaacactacggagactccgagaagggccgattcaccgtctccagagacaattccaggaacacactgcatctgcaaatgtacaacctcacaagtgaggacacggctgtctattattgtgcgagagcccctcgagacggtccccgcttgactactggggccagggaaccctggtcaccgtctcctcagcctccaccaagggcccatcggtcttccccctggcgccctgctccaggagcacctccgagagcacagcggccctggctgcctggtcaaggactacttcctatatactgtctgagcgggctg

SEQ ID NO: 789783 - DNA, 607 bp, Homo sapiens
  misc_feature: 60.UNK.UNK.UNK.pb.heavy.1.raw 60
cccgacacgcttgctagggacttggagctaaggacgacatattgcctttagacagtcgaaggtgacgccttagctaccactgaacgtttaggcgccagatgcgtctgggatgacctaactcgcagcttatcgatgatctactgcacgctcaaccaaccaggtcttgatgcgcgcgataggactgacggatcgctacagacatttaactcgctagtaacttaattgagatcctaggggatgggataggaaatagaatccacccctatcaccccccccacaatagcctgcttgggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagctttgacctggaccagggtgcattagcctgcccagccttc

SEQ ID NO: 789784 - DNA, 728 bp, Homo sapiens
  misc_feature: 124.UNK.UNK.UNK.pb.heavy.1.raw 124
ctaatgcgccttgccagcccgcctcaagacagtatataggaaagtagtccttgaccaggcagcccagggccgctgtgcccccagaggtgctcctggagcagggcgccaaggggaagaccgatgggcccttggtggaagctgaagagacggtgaccattgtcccctggccccaaatatcaaatgcatcgacgtcccaggatcgcctggcgcagtaatagacgcctgtgtcgtcgggtctcaggtttgctcatttgtaaatggccaacactgttggagttcatcccttgagacggtgaatcttcccttcacagacgcggcgtaactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagccccccccgactccgccagtcgcccctcgcactgaacaccttctaaaaaaactacaaggaaaatcaagattagccccaaactccatgggttggtggtctgtgctccagtgctgatcaccaagtggaaactcctgggaatcttcacgggctggggctcctctcccagagctcccctttgtgtgttcagacgtctgctaaatcgaggcaccggtcgtgtaatatactgtctgatggcgcgagggaggcgatacg

SEQ ID NO: 789785 - DNA, 719 bp, Homo sapiens
  misc_feature: 126.UNK.UNK.UNK.pb.heavy.1.raw 126
ctatgcgccttgccagcccgctcagacagtatataggaagtagtccttgaccaggcagcccagggccgctgtgcccccccagaggtgctcctggagcagggcgccaggggaagaccgatgggcccttggtggaagctgaagagacggtgaaccattgtcccctggcccaaatatcaaatgcatcgacgtccaggatcgcctggcgcagtaatagacgcctgtgtcgtcgggtctcaggttgctcatttgttaaaatggccaacactgttggagtcatcccttgagacggtgaatcttcccttcacagacgcggcgtactctttacttccaccataacgtttcattctgacgaaagtgatccactcaagcccttccctggagcctgacggacccaggccaagtgataatcactaagactgaatcctgagactacacaggagagtctcagagaccgccctggctgtgccaagccccccccccgactccgccagtcgccctcgcactgacaccttctaaaaaaactacaaggaaaatcaagattagccccaaactccatggttggtggtctgtgctcagtgctgatccaccaagtggaaactcctggggaatctcacggctggggctctctcccagagctcccctttgtgtgttcagacgtcctgctaaatcgagcacccggtcgtgtatatactgtctgatggcgcgagggaggcgatacg

SEQ ID NO: 789786 - DNA, 611 bp, Homo sapiens
  misc_feature: 128.UNK.UNK.UNK.pb.heavy.1.raw 128
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgcccactcgtaaaactagtactttgcggttaggggaagtagacaaacccattactccacttcccggaagttcaactcattccaacacgaaataaaagtaaactcaacaccccaaagcaggctatgtggggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgctaaaacgttcagtggtagctaaggcgtcacccttcgactgtctaaaggcaatatgtcgtccttagctccaagtccctagcaagcgtgtcgg

SEQ ID NO: 789787 - DNA, 707 bp, Homo sapiens
  misc_feature: 130.44.62.F07.1.pb.heavy.1.raw 130
ctatgcgccttgccagcccgctcagacagtatataggaagtagtccttgaccaggcagcccagggccgctgtgcccctcaggaggtgctctggagcagggcgccagggggaagaccgatggcccttggtggaggctgaagagacggtcaccactgtcccccggccccaagtactaaaggtgtcatggggggtcaccgtggtctggctttcaaacagtaatagacgcctgtgtcctcgggtctcaggtttttcatttgagaaacaattgtcctgcgaattgtccctggaaatggtgaagcggcccttcacggagtctccgtagaaagtgacaccaccagctccgatacttgagacccactccagtccctccctggagcccggcggaccccaggtcatgccataggcactaaaggtgaatccagaggccgcacaggagagggtcagggacctcccaggccgaatcaggcccccccagactccaacaactgcacttcacacacgacaccctttaaaaaagccacaagaaaaaggcagctcagcccaaactccatggagacttctctctgttcggtcctggtcaccaaatgaagacacctgaaaatcccaggctgggctcctctctcagagctcccctttccctttatgcgactactaaatcgagcaccggtcgtgtatatactgtctgatggcgcgagggaggcgatacg

SEQ ID NO: 789788 - DNA, 702 bp, Homo sapiens
  misc_feature: 143.UNK.UNK.UNK.pb.heavy.1.raw 143
ctatgcgcctgccagcccgctcagacagtatataggaagtagtccttgaccaggcagcccagggccgctgtgtccccagaggtgctcttggaggaggtgccagggggaagaccgatgggcccttggtggaggcggaggcgacggtgaccagggttccctggccccagaagtcaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagcccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgcttgatcaccgaatggaaacacctcggaatcccagtgctgggctcctctccccccaaacccaaacgtgcgagtgctaaatcgagcacggtcgtgtatatactgtctgatggcgcgagggaggcgatacg

SEQ ID NO: 789789 - DNA, 705 bp, Homo sapiens
  misc_feature: 157.UNK.UNK.UNK.pb.heavy.1.raw 157
cgtatcgcctccctcgcgccatcagacagtatataccacgacggtgctcgatttagtagtcgcataaaggaaagggagctctgagagaggagcccagccctgggattttcaggtgtcttcatttggtgaccaggaccgacagagagaagtctccatggcgtttgggctgagctgcctttttcttgtggcttttttaaaggggtgtcgtgtgtgaagtgcagttgttggagtctggggggggcctgattcggcctgggagggcgcctgacctctcctgtgcggcctctggattcacctttagtgcctatggcatgacctgggtccgccgggctccagggaggggactggagtgggtctcaagtatcggagctggtggtgtcactttctacggagactccgtgaagggccgcttcaccatttccagggacaattcgcaggacaaattgtttctccaaatgaaaaacctgagacccgaggacacaggcgtctattactgtttgaaagccaggaccacggtgaccccccatgacacctttagtacttgggccggggacagtggtgaccgtctcttcagcctccaccaagggcccatcggtcttcccctggcgccctgctcaggagcacctccgagagcacagcggccctgggctgcctggtcaagactacttcctatatactgtctgagcgggctggcaaggcgcatag

SEQ ID NO: 789790 - DNA, 703 bp, Homo sapiens
  misc_feature: 168.44.45.E01.1.pb.heavy.1.raw 168
ctatgcgccttgccagcccgctcagaacacgtataataggaagtagtccttgaccaggcagcccagggccgctgtgctctcggaggtgctcctggagcagggcgccagggggaagaccgaatgggccttggtggaaggctgaggagaacggtgaccaggcctccctggccccagtagaacgatgggctcgtacaataatagagagccgagtcctcggcttcatccaaaattgttcattttgtagatacacggtgttcttggaattgtctctggagacggagaatcggcccttcacggaagtttccatagtatctctttacttccatcagaccagatgactgccacccactccagccccttgcgcctggagcctggcggacccagtgcatggcagagtcactgaaactgagtccggacgcaaccacaggagagtctcagggacgtcccaggctggaccacgcctcccccagactccaccagctgaacctgacactggacacctcttaaaagagcaacggaggaaaacccagctcagcccaaactccatggtgagttcctctgtgttcagtgctgatcaccccagaatggaaacaccgccgacttctagtgctgggctcctctcccagcccctttcccttactgactcactaaaatcgagcaccggtcgtgtatatactgtctgatggcgcgaggaggcgatacg

SEQ ID NO: 789791 - DNA, 652 bp, Homo sapiens
  misc_feature: 202.44.86.H09.1.pb.heavy.1.raw 202
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgcccagtataatggatgtcaccaatccactccattcccctccctgggggctgccggatccagcccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 789792 - DNA, 699 bp, Homo sapiens
  misc_feature: 218.44.71.G05.1.pb.heavy.1.raw 218
cgtatcgcctccctcgcgccatcagacagtatatacacgaccggtgctcgatttagtgtcgtcgcaagagagaggagccccagccgtgagattcccaggagtttccacttggtgatcagcactgagccacagaccaccaaccatggagtttgggctaatcttgattttccttgtagtttttttagaaggtgtccagtgcgaggggcgactggcggagtcgggggggggcttggcacagccagggcggtctctgagactctcctgtgtagtctcaggattcagtcttagtgattatcacttggcctgggtccgtcaggctccagggaaggggcttgagtggatcactttcgtcagaatgaaacgttatggtggaagtaaagagtacgccgcgtctgtgaagggaagatttcaccgtctcaagggatgactccaacagtgttggccatttacaaatgagcaacctgagacccgacgacacaggcgtctattactgcgccaggcgatcctgggacgtcgatgcatttgatatttggggccagggggacaatggtcaccgtctcttcagcttccaccaagggcccatcggtcttccccctggcgccctgctccaggagcacctctggggggcacagcggccctgggctgcctggtcaaggactacttcctatatactgtctgagcggctggcaaggcgcatag

SEQ ID NO: 789793 - DNA, 707 bp, Homo sapiens
  misc_feature: 231.44.27.C05.1.pb.heavy.1.raw 231
ctatgcgccttgccagcccgctcagacagtatataggaagtagtccttgaccaggcagcccagggccgctgtgctctcggaggtgctcctggagcagggcgccaggggaagaccgatgggcccttggtggaggccgaggagacggtgaccagggttccctggccccaggcgtcgaatgaaccgatttggaaacagatagtctcgcacaaaaatacacggccgtgtcctgaaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggaccccactgcatattccaattatcgaaggtgaaatccagaggctgcacaggagagtctcagggacccccctactgggccacgcctcccccagactccacgaattgcacctggacacatgacacctcttaagagggcaacgaggaaaacccagctcagcccaaactccatggtgagtcctctgtgtttcagtgatgatcaccgagtggaaacaccggcgacttccagtgctgggctcgtctcccaggccccaaacccttcgatcgcgtctaaatcgagcaccggtcgtgtatatactgtctgatggcgcgagggaggcgatacg

SEQ ID NO: 789794 - DNA, 654 bp, Homo sapiens
  misc_feature: 236.44.86.H09.1.pb.heavy.1.raw 236
ctatgcgcctgccagcccgctcagacagtatataggaagtagtccttgaccaggcagcccagggccgctgtgcccccagaggtgctcctggagcagggcgccaggggaagaccgatgggccttggtgaagctgaggagacagtgaccaggggtgccacggccccatagattgaaagaccagtctcgcctcgcacagaaataaacggccgtgtccgcggcggtcacggaggtccagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 789795 - DNA, 728 bp, Homo sapiens
  misc_feature: 267.44.86.H09.1.pb.heavy.1.raw 267
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggaccagtgcatgccatgtctgttgaaggtgaaatccagacgctacacaggagagtctcagggaacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagagctccccaacccaagtctatagcactaaatcgagcaccggtcgtgtatatactgtctgatgcgcgaggaggcgatacg

SEQ ID NO: 789796 - DNA, 710 bp, Homo sapiens
  misc_feature: 290.44.27.C05.1.pb.heavy.1.raw 290
ctatgcgccttgccagcccgctcagacagtatataggaagtagtccttgaccaggcagcccagggccgctgtgctctcggaggtgctcctggagcagggcgccagggggaagaccgatgggcccttggtggaggcgagagacggtgaccagggttccctggccccaggcgtcgaatgaaccgattttggaaacagatagtctcgcacaaaaatacacggccgtgtcctgaggtctcaggctgttcatttgaagagaccactgtgttctcgaattgtctctggagatggtgaatcggccctcaacggaatcaccgtagacttgatttcctccatgaaatgacacacctgccacccactccagcccctcgcctggagcctggcggacccactgcatatttccaattatcgaagtgaaatcagaggctgcacaggagagtctcagggaccgccccctactggggcacgcctcccccagactccacgaattgcaccctgacacatgacacctcttaagagggcaacgaggaaaacccagctcagcccaaaactccatggtgagtccttctgtgttcagtgatgatcaccgagtggaaacaccggcgacttccagtgctgggctcgtctcccagggctccccaaacccttcgatcgcgtctaaatcgagcaccggtcgtgtatatactgtctgatggcgcgagggaggcgatacg

SEQ ID NO: 789797 - DNA, 705 bp, Homo sapiens
  misc_feature: 291.44.70.G04.1.pb.heavy.1.raw 291
cgtatcgcctccctcgcgccatcagacagtatatacacgaccggtgctcgatttagtgtagtgtgaagggaaaggggtctgggagaggagcccagcactagaagtcgcggtgtttccattcggtgatcaggcactgaacacagaggactcaccatggagtttgggctgagctgggttttcctcgttgctcttttaagaggtgtccactgtcaggtgcacctggtggagtctgggggaggcgtgtccagcctgggaggtccctgagactctcctgtgaagcctctggatttagtttcagtggttctggcatgcactgggtccgccaggctccaggcaaggggccggagtggttggcagtttatagcacatgatggaagttctgaatattatgcagactccgtgaagggcgattcaccatctccagagacaattccggaacatgtgtacttggaaatggtcagccctgagagtcgaggactcggctctgtattactgtgcgagatcgggaggtggtagtagttattaccggcgccatgactggggccagggaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 789798 - DNA, 702 bp, Homo sapiens
  misc_feature: 294.44.36.D03.1.pb.heavy.1.raw 294
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggttgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctccccggactccaccaactgcacttcactctggacaccttgtaaaataacaacaaggaaaaccagctcagcccgaactccatggtgagtcctctgtgttcagtgctgatcaccaaatgaaaacaacctgggaattctgggctggggctccgctctcagagctccccaagagagatcgtgacgcagctaaatcgagcaccggtcgtgtatatctgtctgatggcgcgagggaggcgatacg

SEQ ID NO: 789799 - DNA, 736 bp, Homo sapiens
  misc_feature: 319.44.56.F01.1.pb.heavy.1.raw 319
cgtatcgcctccctcgcgccatcagacagtatatacacgaccggtgctcgatttagcagacgtctggaaacacacaaaggggagctctggagaggagccccagccgtgagattcccaggagtttccacgttgggtgatcagccactgagcacagaccaccacaaccatggagtttgggctaatcttgttttccttgtagtttttttagaaggtgtccagtgcgagggcggactggggagtcggggggggggcttggcacagccagggggcggtctctgagactctcctgtgtagtttcctccagattcaggtcttagtgattatcacttggcctgggtccgttcaggctccagggaaggggcttgagtggatcaactttccgtcagaaggaaacgttatggtggaagtaaagagtagcgccgcgtctgtgaagggaagattcaccgtctcaagggatgactccaacagtgtggccatttacaaatggcaacctgagacccgacgacacaggcgtctattactgcgccaggcgatcctgggaacgtcgatgcatttgatatttggggccagggggacaatggtcaccgtctcttcagcttccaccaagggcccatccggtcttccccctggcgccctgctccaggagcacctctgggggccagcggccctgggctcgcctggtcaaggactacttcctatataccctgctgtctgagcgggctggcaaggcgcatag

SEQ ID NO: 789800 - DNA, 675 bp, Homo sapiens
  misc_feature: 363.UNK.UNK.UNK.pb.heavy.1.raw 363
ctatgcgccttgccagcccgctcagacagtatataggaagtagtccttgaccaggcagcccagggccgctgtgctctcggaggtgctcctggagcagggcgccagggggaagaccgatgggccttggtggaggccgagagacggtgaccagggttccctggccccaggcgtcgaatgaaccgatttggaaacagatagtctcgccaaaatacacgccgtgtctgaggtctcaggctgttcatttgaaggacactgtgttctcggaattgtctctggagatggtgaatcggccctcaacggatcaccgtagacttgatttcctccatgaaatgacccctgcacccacctccagcccctcgcctggactggcggacccactgcatatccaattatcgaaggtgaatccagaggcgcacaggagagtctcagggaccccctactggggcacgcctccccagactccacgaattgcacctgacacatgaaccttcttagaggcaacgaggaaaacccagcttcagcccaaatccatggtggtcccctgtgttcagtgattcaccgtggaaacaccgcgactccagtgctggccgtcccagggctccccaaacccttcgatcgcgtctaaatcgagcacggtcgtgtatatactgtctgatggcgcgaggaggcgatacg

SEQ ID NO: 789801 - DNA, 687 bp, Homo sapiens
  misc_feature: 418.44.21.B10.1.pb.heavy.1.raw 418
ctatgcgccttgccagcccgctcagacagtatataggaagtagtccttgaccaggcagcccagggccgctgtgctctcgaggtgctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctctcttgcgacgacactaaatcgagcaccggtcgtgtatatactgtctgatggcgcgagggaggcgatacg

SEQ ID NO: 789802 - DNA, 673 bp, Homo sapiens
  misc_feature: 437.UNK.UNK.UNK.pb.heavy.1.raw 437
cgtatcgcctccctcgcgcatcagacacgaccgggtgctcgatttagagagagtgtgttgagctctggagaggagcccagccttgggattccaggtgttttcattcagtgatcaggactgaacacagaggactcaccatggagtttggggctgagctggattttccttgctgctattttaaaggtgtccagtgtgaggtgcagttggtgagtctgggggaggtttggtaaagcctggggagtcccttagactctcctgtggcagcctctggattcactttcagtaacgcctggatgacctggtccgccaggctccagggaaggggctggagtgggttggccgtattagaaccaaagctgacggtgggacagcagactacgcctgccacccgtgaaaggcagattcaccatctcaagagatgattcaaagatacggtgtctctgcagatgaacagcctgaacaccgagggacacagccgtctattactgtctgggatggtttcattcgggccaggaaccctggtcacgcgtctcctcagcctccacaagggcccatcggtcttccccctggcgccctgctccaggagcacctccgagagcacagcggccctgggctgcctggtcaaggactacttcctatatactgtctgagcgggcctggcaaggcggcatag

SEQ ID NO: 789803 - DNA, 666 bp, Homo sapiens
  misc_feature: 460.44.29.C07.1.pb.heavy.1.raw 460
cgtatcgcctccctcgcgccatcagacagtatatacacgaccggtgctcgatttagagtgctacgaagggaaaggggactcctgtgccccaccatggacacactttgctccacgccctgctgctgaccatccgcttcatggtcttgtcccagatcaccttgaaggagtctggtccacgctggttgaagcccacacagaccctcacgctgacctgcaacctctctggtttctcactcaggagtgatggagcgattgtggggctgggtccgtcagcccccaggaaaggccctggagtggcttgcactcatttattggatgatgataggcgctacagtccatctctgaagagcagacctccatcaccggagacgcctccaatacgcaggttgatccttagagtgggccaacatggcccctgcggaccacaagccacatactactgcgcacacatgatcaactattataaaagtggtggttatgtgagtggctttgatatctggggccaagggacaatgtcaccgtctcttcagcctccacccaaggggcccatcgtcttcccccctggcgccctgctccaggagcacctccgagagcacagcggccctgggctgcctggtcaaggactacttcctatatactgtctgagcgggctggcaaggcgcatag

SEQ ID NO: 789804 - DNA, 654 bp, Homo sapiens
  misc_feature: 493.44.86.H09.1.pb.heavy.1.raw 493
ctatgcgccttgccagcccgctcgacagtatataggaagtagtccttgaccaggcagcccagggccgcgtgtgccccagagggtgctcctggagcagggcgccagggggaagaccgatgggcccttggtggaagctgaggagacagtgaccagggttgccacggccccatagattgaaagaccagtctcgcctcgcacagaaataaacggccgtgtccgcggcggtcacggaggtcagtttcagggagaagcggttcatggacgtgtccctcgaaaggtgagacgactcttgagggacggagagtagtacgtcgcccagtataatggatgtcaccaatccactccattcccctccctgggggctgccggatccagcccaagaatgatcagaactgatggaaactccagagacagtgcagatgagagacaggggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatccccaacccaagtctatagcactaaatcgagcaccggtcgtgtatatactgttctgatggcgcgagggaggcgatacg

SEQ ID NO: 789805 - DNA, 706 bp, Homo sapiens
  misc_feature: 496.44.62.F07.1.pb.heavy.1.raw 496
cgtatcgcctccctcgcgccatcagacagtatatacacgaccggtgctcgatttagtagtcgcataaagggaaaggggagctctgagagaggagcccagcctggatttcaggtgttcttcatttggtgaccaggaccgaacagagagaagtctccatggagtttgggctgagctgcctttttcttgtggctttttttaaagggtgtcgtgtgtgaagtgcagttgttggagtctgggggggcctgattcggcctgggaggtccctgacctctcctgtgcggcctctggattcacctttagtgcctatggcatgacctgggtccgccgggctccaggaggggactggagtgggtctcaagtatcggagctgggggtgtcacttttctacggagactccgtgaagggccgcttcaccatttccagggacaatcgcaggacaaattgtttctccaaatgaaaaacctgagacccgaggacacaggcgtctattactgtttgaaagcccaggaccacgtgaccccccatgacaccttagtacttggggccgggggacagtggtgaccgtctcttcagcctccaccaagggccatcggtcttcccctggcgccctgctccaggagcacctccgagagcacagcggccctgggctgcctggtcaaggactacttcctatatactgtctgagcgggctggccaaggcgcatag

SEQ ID NO: 789806 - DNA, 698 bp, Homo sapiens
  misc_feature: 513.44.36.D03.1.pb.heavy.1.raw 513
cgtatcgcctccctcgcgccatcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggttggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgatttctgcgaatgactaacctgaaaccgaggacacggcatgtattattgtgttgtgtttatatcaggaactgtccactggggccagggaaccctggtcaccgtctcctcagcctccaccaagggcccatcggtcttccccctggcgccctgctccaggagcactccgagagcacagcggccctgggctgcctggtcaaggactacttcctatatactgtctgagcgggctggcaaggcgcatag

SEQ ID NO: 789807 - DNA, 685 bp, Homo sapiens
  misc_feature: 535.UNK.UNK.UNK.pb.heavy.1.raw 535
cgtatcgcctccctcgcgccatcagacagtatatacacgacggtgctcgatttagctgcgtcacgatctctcttggggggagcggagcccagccccagaatcccaggtgttttcatttggtgatcagcactgaacacagaggactcaccatggagttcgggctgagctgggtttccttgttgttattttacaaggtgtccagagtgaagtgcagttggtggagtccgggggagacttggtccagcctggagggtccctgagactctcctgtgtcgctctggattcaccatcagtgaccactatatggactgggtccgccaggctccagggaaggggctggagtggcttggccgcagtaaaacaagtgccagctttatcacagagtacgccgcgtctgtgaaagcagattcacctctcaagagatgacttcaagaactcattgattctgcgatgactaacctgaaaaccgaggacacgggcatgtattattgtgttgtgtttatatcaggaactgtccactggggccagggaaccctggtcaccgtctcctcagcctccaccaagggcccatcggtcttcccctggcgccctgctccaggagcactccgagagcacagcggccctgggctgcctggtcaaggactacttcctatatactgtctgagcgggctggcaaggcgcatag

SEQ ID NO: 789808 - DNA, 711 bp, Homo sapiens
  misc_feature: 576.44.36.D03.1.pb.heavy.1.raw 576
cgtatcgcctccctcgcgccatcagacagtatatacacgaccggtgctcgatttagctgcgtcacggatctctcttggggagctcgagagcggagccccagccccagaattcccaggtgttttcatttggtgatcagcactgaacacagaggactcaccatggagttcgggctgagctgggtttttccttgttgttatttttacaaggtgtccagagtgaagtgcagttggtggagtccgggggagacttggtccagcctggagggtccctgagactctcctgtgtcgcctctggattcaccatcgtgaccactatatggactgggtcccgccaggctccagggaaggggctggagtggcttggccgcagtaaaaacaaagttgccagctttatcacagagtacgccgcgtctgtgaaaagccagattcaccgctctcaagagatgacttcaagaactcattgattctgcgaatgactacctgaaaaccgaggacacgggcatgtattattgtgttgtgtttatatcaggaactgtccactgggggccagggaaccctggtcaccgtctcctcagcctccaccaagggcccatcggtcttcgcccctggcgccctgctccaggagcacctccgagagcacagcggccctgggctgcctggtcaaggactacttcctatatactgtctgagcgggctggcaaaggcgcatag

SEQ ID NO: 789809 - DNA, 621 bp, Homo sapiens
  misc_feature: 589.44.23.C01.1.pb.heavy.1.raw 589
cgtatcgcctccctcgcgccatcagacagtatatacacgaccggtgctcgatttagtacacgtgattagggattgggcaggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtcctgaggcgggctggcaaggcgcatag

SEQ ID NO: 789810 - DNA, 674 bp, Homo sapiens
  misc_feature: 619.44.6.A06.1.pb.heavy.1.raw 619
cgtatcgcctccctcgcgccatcagacagtatatacacgaccggtgctcgatttagatctactgacaaccacattcctcctctaaagaaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccgggcagaattacgattaccgcggacaagtccacagacacagtctccatgacaatgagttctttgaaatccgacgacacggccgtctactactgtgcgagaggtccgtaccccagctcgcatggagcctttgagatctgggggcaggaaccctggtcattgtcacctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 789811 - DNA, 543 bp, Homo sapiens
  misc_feature: 620.44.43.D10.1.pb.heavy.1.raw 620
cgtatcgcctccctcgcgccatcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcggggaggtggttcgacccctggggccagggaaccctggtcaccgtctcctcagcttccaccaagggcccatcggtcttcccctggcgccctgctccaggagcacctctggggcacagcggcctgggctgcctgtcaagactacttcctatatactgtctgagcgggctgcaaggcgcatag

SEQ ID NO: 789812 - DNA, 717 bp, Homo sapiens
  misc_feature: 646.44.55.E11.1.pb.heavy.1.raw 646
ctatgcgccttgccagcccgctcagacagtatataggaagtagcttcctttgaaccaggcagcccaggccgctgtgcccccagaggtgctcttggaggagggtgccagggggaagaccgatgggcccttggtggaggcggaggcgacggtgaccagggttttccctggcccagaagtcaaacgaataataaccactccgagcgccgacttgtctcgcacagtaaatagacggccgtgtcgtcgcctctcaggttgttcatttgaagataaaccgtgttcctggaattgtcccctggagatggtgaatcggcccttcacggagtctgcgtagtatgtgaaatcaccagtataaaatgactgagaccactccagcccctttccctgcgagcctggcggacccaactcatgtagttgctgctgacggtgagcccagaggctgcacaggagagtctctggaccccccaggctggactaagcctcctccagactccatcaggccgcacctcacactggacaccttttaaaagtccaacaaggagaacccagctcagccaaaactccatggtgagtcctctgtgttcagtgctgatcaccgaatggaaacaccttcggaatcccagtgctgggctcctctcccccccaaaacccaacgtgcgagtgctaaaatcgagcaccggtcgtgtatatactgtctgatggcgcgagggaggcgatacg

SEQ ID NO: 789813 - DNA, 697 bp, Homo sapiens
  misc_feature: 717.44.73.G07.1.pb.heavy.1.raw 717
ctatgcgccttgccagcccgctcagacagtatataggaagtagtccttgaccaggcagcccaggccgctgtgctctcggaggtgctcctggagcagggcgccagggggaagaccgatgggcccttggtggaggctgaaggagacggtgaccagggttccctggccccagtagtcaagcggggaccgtctcgagggggctctcgcaccaataatagacagccgtgtcctcacttgtgaggttgtacatttgcagatgcagtgtgttcctggattgtctctggagacggtgaatcggccccttctcggagtctccgtagtgttcttcaatttccatcttctgatataattgccacccactccagccccttgcctggagcctggcggacccagtgcatggcataggtcctgaagatgaatccagaggctgcacaggagagtctcagggagttcccaggctgggccgctcctcccccagactccactagctgcacctgacactggccaccttctttaaaagagcaacgaggaaaacccatctcagcccaaagtccatggtgagtcctctgtgttcagtgatgatcaccgaatggaaacaccggcgacttccagtgctgggctcgtctcccccctgagcgtagagctaaatcgagcaccggtcgtgtatatactgtctgatggccgcgagggaggcgatacg

SEQ ID NO: 789814 - DNA, 695 bp, Homo sapiens
  misc_feature: 740.UNK.UNK.UNK.pb.heavy.1.raw 740
ctatgcgccttgccagcccgctcagacagtatataggaagtagtccttgaccaggcaggcccagggccgctgttgccccagaggtgctcctggagcagggcgccagggggaagaccgatggcccttggtggaagctgaggagacggtgaccagggttccctggccccaggggtcgaaccaatttccatgtgtgggactatgagagggactatgaaagttgacgagggctctcgcacagaaatagatgccgtgtcttcagatctcagcctgctcagctccatgtaggctgtactcgtggattcgtccgcggtaatggtgactctgtcctgaaacttctgtgcgtaattcgatggcaccaaagatagggatgatccctccagccactcaagcccttgtccaggggcctgtcgcacccaaataaaagcatagctgaagaaggtgcctccaggaaggccttgcaggagaccttcaccgaggacccaggcttcttcacctcagccccagactgcaccagctgcacctgggactggacacctgtagctgctgccaccacaaagaggaaccgccaggtccagtccatggtgatgagctgtgctcccaggggcttctttagaggaggagtgtggttgttatgtgatcaaaatcgagccgccgtcgtgtatatactgtctgatggcgcgagggaaggcgatacg

SEQ ID NO: 789815 - DNA, 594 bp, Homo sapiens
  misc_feature: 750.UNK.UNK.UNK.pb.heavy.1.raw 750
cccgacacgcttgctagggacttggagctaaggacgacatattgccttagacagtcgaaggtgacgccttagctaccactgaacgtttaggcggccagatgcggtctgggatgacctaactcgcagcttatcgatgatctactgcacgctcaaccaaccaggtcttggatgcgcgcgataggactgacgggatcgctacagacatttaaactcgctagtaacttaattgagatcctaggggatgggataggaaatagaatccacccctatcaccccaccatagcctgcttggggtgttgagttacttttatttcgtgttggaatgagttgaacttccggagtgagtaatggtttgtctctccctaaccgcaaagtactagttttacgagtgcgttgcaagccatagccagtcacaggtaataaacaattcacgtggcgaaagattggccgcttgctgtgggcatttgcaagctgggtttgcagcattgtgcatgctagacgacaatatgaatctgcggaccctagtggccaagatggccgctagcggttccgcagctttgactggacagggtgcatagcctggccagcctcttc

SEQ ID NO: 789816 - DNA, 706 bp, Homo sapiens
  misc_feature: 827.UNK.UNK.UNK.pb.heavy.1.raw 827
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggcccagtggacagttcctgatataaacacaaccacaataatacatgcccgtgtcctcggttttcaggttagtcattcgcagaatcaatgagttcttgaagtcatctcttgagagggtgaatctggctttcacagacgcgggcgtactctgtgataaagctggcaactttgtttttactgcgggccaagccactccagccccttccctggagcctggcggacccagtccatatagtggtcactgatggtgaatccagaggcgacacaggagagtctcagggaccctcccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctgggctccgctctcagagctcccccaagagagatcgtgacgcagctaaatcgagcaccgtggtgatatactgtctgatggcgcgagggaggcgatacg

SEQ ID NO: 789817 - DNA, 731 bp, Homo sapiens
  misc_feature: 872.UNK.UNK.UNK.pb.heavy.1.raw 872
ctatgcgccttgccagcccgctcagacagtatataggaaagtagtcctctgaccaggcagcccaggggcgcgctgtgccccagaggtgctcttggagggaggtgccaggggaagaccgatgggcccttggtggagctggaaggagacggtgaccgtggtccctggccccagacgtccataccgtagtagtagtccagcaggtggtagttactacaaaatatgtcctcgcacagtaatacacagccgtcgtcctcggcttctcaggctgcgttcatttgcagatacagcgtgtttctttggaatctgttcttggagatggtgaatcgcgcccttcacggagtctgcatagtatttattacttccatcataccatataagtgccacccactccagccccttgcctggagcctggcggacccgtgcatgccatagtacgaaggtgaatccagacgctgcacaggagagtctcagggactcccaggctgacacgcctccccagactccaccagctgcacctgacaactgaccacctcttaaaaagagcaacgaggaaaacccagctcagccaaactccatggtggagtcctctgttgttcagtgcgatcacgaatggaaacaccgcgactttctaagtgctgggctcctctcccagagctcccgcgactgagtgatactaaatcggagcaccggtcgtgtatatactgttctgatggcgcgagggaggcgatacg

SEQ ID NO: 789818 - DNA, 684 bp, Homo sapiens
  misc_feature: 893.UNK.UNK.UNK.pb.heavy.1.raw 893
ctatgcgccttgccagcccgctcagacagtatataggaagtagtccttgaccaggcagcccagggccgcgtgcctctcggaggtgctcctggagcagggcgccagggaagaccgatgggccctggtggaggccgaggagacgggaccagggttccctggcccaggcgtcgaatgaaccgatttgaaacagatagtctcgcacaaaaatacacggccgtgtcctgaggtctcaggctgttcatttgaagagacactgtgtctcggaatgtctctggagatggtgaatcggccctcaacggaatcaccgtagacttgattcctcatgaaatgacacacctgccacccactccagcccctcgctggagcctggcggaccactgcatattccaattatcgaaggtgaatccagaggctgcacaggagagtctcagggaccccctacggggccacgcctccccagactccacgaattgcacctgacacatgacacctcttaagagggcaacgaggaaaacccagctcagccaaactccatggtgagtcctcttgtttcgtgatgatcaccggagtggaaacacggcgacttccagtgctggctcgtctccagcccaaaacccttcgatcgcgtctaaatcgagcaccggcgtgtatatactgtctgatggccgcgagggaggcgatacg

SEQ ID NO: 789819 - DNA, 625 bp, Homo sapiens
  misc_feature: 935.UNK.UNK.UNK.pb.heavy.1.raw 935
ccgctcagacagtatataggaagtagtccttgaccaggacatcagcccagggccgctgtgcccccccagaggtgctcctggagccagggcgccagggggaagaccggatgggcccttggtggaagctgaggagacagtgaccagggtgccacggccccatagattgaaagaaccagtctccgcctcgcaaccagaaataaacgggccgtgtccgcggcggtcacggaggtcagttcaggagaagcggttcatggacgtgtccctcgaaatggtgagacgactctttgagggacggagagtagtacgttcgccccagtataatggatgtcacccaatccactccattcccctccctgggggctgccggatccagccccaagaatgatcagaactgatggaaactccagagacaggtgcagattgagagacagggttcccgaaggcctcaccagtcctgggcccgactcctggcagctgcacctgggacaggacccatctgggagctgccaccagcaggaggaaaaaccacaggtgtttcaaccctgccccaattccctaatcacgtgtactaaatcgagcaccggtcgttgtatatactgtctgatggcgcgagggaggcgatacg

SEQ ID NO: 789820 - DNA, 630 bp, Homo sapiens
  misc_feature: 974.44.38.D05.1.pb.heavy.1.raw 974
cgtatcgcctccctcgcgcatcagacagtatatacacgaccggtgctcgatttagtatctgatagctgggttttccttgttgctattttaaaagtgtccagtgtgaggtgcagctggtggagtccgggggaggcttgttcagcctagggggggtccctgagactctcctgtgcagcctctggattcaccttcagtagcctactggatgcactgggtccgccaagctccagggaaggggctgggtgtgggtctcacgtattaatagtgatgggaagtagcacaagctacgcggacctccgtgaaggcgccgatacaccatcttccagagacaacgccaaagaacacgctgtatctgcaaatgaacagtctgagagccgaggacacggctgtgtattactgtggcaagagccggtgcgggagttcgggagttgcatacttactactacggtgatggacgtctggggccaagggaccacggtcaccgtctcctcagcttccaccaagggcccatcgggtcttccccctggcgccctgctccaggagcacctctggggcacagcggccctgggctgcctggtcaaggactacttcctaagtatactgtctgagcgggctggcaagggcgcatag

SEQ ID NO: 789821 - DNA, 682 bp, Homo sapiens
  misc_feature: 987.44.36.D03.1.pb.heavy.1.raw 987
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccctggcgccctgctccaggagcacctccgagagcacagcggccctgggctgcctggtcaaggactacttcctatatactgtctg

SEQ ID NO: 789822 - DNA, 704 bp, Homo sapiens
  misc_feature: 993.UNK.UNK.UNK.pb.heavy.1.raw 993
cgtatcgcctccctcgcgccatcagacagtatatacacgacggtgctcgatttagctgcgtcacgatctctcttgggagctctcagagaggtgccttagccctggattccaaggcatttccacttggtgatcagcactgaacacagaggactcaccatggagttggggctgcgctggttttccttgttgctatttttagaaggtgtccactgtgaggtgcggctgtggagtctgggggaggcttggtacagcggggggggtccctgagactctcctgtgcagcctctggattcatcttcagtgactatgccatgaactgggtccgccaggctccaggaaggggctggagtgggtttcatatgttaatattgctggagataccacctactacgcagactctgtgaagggccgattcaccattccagggacaatgccaagaactcactgtatctggaaatgaacagcctgagagacgaggacacggctgtctacttctgttcgagagatcgggccacttggtcagtggctggttttgactactgggccggggaaccctggtcaccgtctcctcagcctccaccaagggcccatcggtcttcccctggcgccctgctccaggagcacctccgagagcacagcggcctgggctgcctggtcaaggactacttcctataactgtctgagcgggctggcaaggcgcatag

SEQ ID NO: 789823 - DNA, 702 bp, Homo sapiens
  misc_feature: 994.UNK.UNK.UNK.pb.heavy.1.raw 994
ctatgcgccttgccagcccgctcagacagtatataggaagtagtccttgaccaggcagcccagggccgctgtggcccccagaggtgctcttggaggagggtgcagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagaccactccagccccttccctggagcctggcggacccaactcatgtagttgctgctgacggtgagccagaggctgcacaggagagtctctgggacccccaggctggactagcctcctccagactccatcagccgcacctcacactggacacctttaaaagtccaacaaggagaacccagctcagccaaaactccatggtgagtcctctgtgttcagtgctgatcaccgaatggaaacacctcggaatcccagtgctgggctcctctcccccccaaaacccaacgtgcgagtgcctaatcgagcaccggtcgtgtatatactgtctgatggcgcgagggaggcgatacg

SEQ ID NO: 789824 - DNA, 621 bp, Homo sapiens
  misc_feature: 1004.UNK.UNK.UNK.pb.heavy.1.raw 1004
cgtatcgcctccctcgcgccatcagacagtatatacacgaccggtgctcgatttagctgcgtcaacgatctctctgggtctgtcccaggtcaccttgaggagtctggccggtgctggtgaagcacagagaccctcacgctgacctgcccatctctgggttcctctcaacgatattagaatgggtgtgagctggatccgtcagcccccagggaaggccctggatgtggcttgccacatcttctcgaattgacgaataaaatcctacagtaacatctctgaaggcagtttaaccatctccaaaggacacctccaaaagcgcaggtggtctttagttatgaccacatggaccctgcggaccaggcacatattactgtgctaatcggcgtccactagcgggaatcagacaacagctggttctgtatctagtaagtcctccaccatctggaccgtctggggcaaaggacccaccggtcaccgtcggtcctcagcttccaccaagggcccatcggtcttccccctggggcgccctgccccaggagcacctctgggggcacagcggccctggggctgcctggtcaaggaactacttcctatatcctgtctggcggctggcaatcccta

SEQ ID NO: 789825 - DNA, 654 bp, Homo sapiens
  misc_feature: 1032.44.12.B01.1.pb.heavy.1.raw 1032
ctatgcgccttgccagcccgctcagacagtatataggaagtagtccttgaccaggcagcccaggccgctgtgccccagaggtgctcttggaggagggtgccaggggaagaccgatggcccttggtggaggctgaggagacggtgaccagggttccctggcccagtggtcaaagtagttggtgacgaactgccctactctcgcacagtaatacacggccgtgtccgcggcggtcacagagctcagcttcaggagaactggttcttggacgtgtctactgatatggtgactcgactcttgagggacgggttgtagtaggtgctcccactataatagatactcccaatccactccagccccttccctggggctggcggatccagccccagtagtaactactactgctgatggagcaccagagacagtgcaggtgagggacagggtctccgaaggcttcaccagtcctgggccgactcctgcagctgcagctgggacaggacccatctgggagccgccaccagcaggaggaagaaccacaggtgcttcatgttcttgcacaggaggtcatgactctcagaaagccccgcggaatctacactactaaatcgagcaccggtcgtgtatatactgtctgatggcgcgagggaggcgatacg

SEQ ID NO: 789826 - DNA, 695 bp, Homo sapiens
  misc_feature: 1034.UNK.UNK.UNK.pb.heavy.1.raw 1034
cgtatcgcctccctcgcgccatcagacagtatatacacgacggtgctcgatttagctgcgtcacgatctctcttgggggagctctgagagcggagccccagcccagaattcccaggtgtttcatttggtgatcagcactgaacacagaggactcaccatggagttcgggctgagctgggtttttccttgttgttattttacaggtgtccagagtgaagtgcagttggtggagtccgggggagacttggtccagcctggaggtcctgagactctcctgtgtcgcctctggattcaccatcagtgaccactatatggactgggtccgccaggctccagggaaggggctggagtggcttggcgccagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtggttgtgtttatatcaggactgtccactgggccaggaacccctggtcaccgtctcctcagcctccaccaagggcccatcggtcttcccctggcgcctgctccaggagcacctcgagagcacagcggccctggctgcctggtcaaggactacttcctatatactgtctgagcgggctggcaggcgcatag

SEQ ID NO: 789827 - DNA, 678 bp, Homo sapiens
  misc_feature: 1046.UNK.UNK.UNK.pb.heavy.1.raw 1046
ctatgcgccttgccagcccgctcagacagtatataggaagtagccttgaccaggccagcccagccgctgtgctctcggaggtgctcctggagcagggcgccaggggaagaccgatgggcccttggtggaggccgggagacggtgaccagggttccctggccccaggcgtcgaatgaaccgattttggaaacagatagtcctcgcacaaatacacggccgtgtcctgaggtctcaggctttcatttgaagagacactgtgttctcggattgtctctggagatggtgaatcggccctcaacggaatcaccgtagacttgatttcctccatgaaatgaacacacctgccacccactccagccctcgcctggagcctggcggacccactgcaatattccaatatcgaaggtgaatccagaggctgcacaggagagtctcagggaccccctactggggccacgcctcccagactccacgaattgcacctgacacatgacacctcttaagagggcaacgaggaaaaaccagctcagccaaactccatggtgagtcctctgtgttcagtgatgatcaccgagtggaaacaccggcgacttcctcttcccccaaacccttcgatccgcgtctaaatcgagcaccggtcgtgtatatactgtctgatggcgcgagggaggcgatacg

SEQ ID NO: 789828 - DNA, 667 bp, Homo sapiens
  misc_feature: 1049.44.71.G05.1.pb.heavy.1.raw 1049
ctatgcgccttgccagcccgctcagacagtatataggaagtagtccttgaccaggcagcccagggccgctgtgccccagaggtgctcttggaggaggtgccaggggaagaccgatgggcccttggtggaggctgaggagacggtgaccggggtccctttgccccagacgtccatgtagtagtaatacttgtattgttgtaacttctgcgaccctctggcacagtaataaagggccgtgtcgtccactcgcaggctcttcatctgcagaaacaccgtattcttggaattgtccctggagacgatgaagcggcccttcacggagtctgcgacatttgtggcactaccaccagtaatggatgagacccactccagccccttccctggggcctgacggacccagatcatggcataggtattaaaggcgatccagaggctgcacaggagagtgtcagggacccccccggctgtaccaagcctcccccgactccaacagctgcacttcacactgacaccttttaaaacagccacaagaaaaagccagctcagcccaaactccatggtgagttctctctgttcagtccccagggctgggcccctctctcttgcgacgacactaatcgagcaccggtcgtgtatatactgtctgatggcgcgaggaggcgatacg

SEQ ID NO: 789829 - DNA, 691 bp, Homo sapiens
  misc_feature: 1084.44.36.D03.1.pb.heavy.1.raw 1084
ctatgcgccttgccagcccgctcagacagtatataggaagtagtccttgaccaggcagcccagggccgctgtgctctcggaggtgctcctggagcaggcgccaggggaagaccgatgggcccttggtggaggctgaggagacggtgaccagggttccctggccccagtggacagttcctgatataaacacaacacaataatacatgcccgtgtcctcggtttcaggttagtcattcgcagaatcaatgagttcttgaagtcatctcttgagagggtgaatctggctttcacagacgcggcgtactctgtgataaagctggcaacttgtttttactgcggccagccactccagccccttccctggagcctggcggacccagtccatatagtggtcactgatggtgaatccagaggcgacacaggagagtctcagggaccctccaggctggaccaagtctccccggactccaccaactgcacttcactctggacaccttgtaaaataacaacaaggaaaacccagctcagcccgaactccatggtgagtcctctgtgttcagtgctgatcaccaatgaaaacacctgggaattctggggctggggctccgctctcccccaagagagatcgtgacgcagctaatcgagcaccggtcgtgtatatactgtctgatggcgcgagggaggcgatacg

SEQ ID NO: 789830 - DNA, 670 bp, Homo sapiens
  misc_feature: 1085.44.55.E11.1.pb.heavy.1.raw 1085
cgtatcgcctccctcgcgccatcagacagtatatacacgaccggtgctcgatttagcactcgcacgttgggtttggggggggagaggagcccagcactgggattccgaggtgtttccattcggtgatcagcactgaacacagaggactcaccatggagtttggctgagctgggttctccttgttggacttttaaaaggtgtccagtgtgaggtgcggctgatggagtctggaggaggcttagtccagcctgggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaaacacggtttatcttcaaatgaacaacctgagaggcgacgacacggccgtctattactgtgcgagacaagtcggcgctcggagtggttattattcgttgacttctggggccagggaaccctggtcaccgtcgcctccgcctccaccaagggcccatcggtcttccccctggcaccctctccaagagcacctctgggggcacagcggccctgggctgcctggtcaaggactacttc

SEQ ID NO: 789831 - DNA, 616 bp, Homo sapiens
  misc_feature: 1088.UNK.UNK.UNK.pb.heavy.1.raw 1088
cccgacacgctgctagggactttggagctaaggacgaacatattgcctttagacagtcgaaggtgaccgccttaagctaccactgaacgtttaggcgccagatgcggtctggatgacctaactcgcagcttatcgatgaatctactgcacgctcaaccaaccaggtcttgatgcgcgcgataggactgacgggatcgctacagacatttaactcgctagtaacttaattgagatcctagggggatggataggaaatagaatccaccctatcaccccccccacatagcctgcttggggtgttgagtttattttttatttcgtgttggaatgagttgaacttccgggaagtggagtaatgggtttgtctacttcccctaaccgcaaaagtactaagttttacgagtggcgttgcaagccatagccagtcacaggtaataaacaattcaacgtggcgtaaagattggccccgcttgctgtgggggcattgcaagctggtttgcagcattgtgcatgctagacgacaatatgaatctgcgggacccctagtggccaagatggccgctagcggttccgcagcttttgacctggaccagggtgcatagcctgcccagccttc

SEQ ID NO: 789832 - DNA, 714 bp, Homo sapiens
  misc_feature: 1097.44.56.F01.1.pb.heavy.1.raw 1097
cgtatcgcctccctcgcgccatcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagtttttttagaaggtgtccagtgcgaggggcgactggcggagtcgggggggggcttggcacagccagggcggtctctgagactctcctgtgtagtctcaggattcagtcttagtgattatcacttggcctgggtccgtcaggctccagggaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgcctattactgcgccaggcgatcctgggacgtcgatgcatttgatatttggggccagggacaatggtcaccgtctcttcagcttccaccaagggcccatcgtcttccccctggcgccctgctccaggagcacctctgggggcacagcggccctgggctgcctggtcaaggactacttccatatatactgtctgagcgggctggcaaggcgcatag

SEQ ID NO: 789833 - DNA, 717 bp, Homo sapiens
  misc_feature: 1098.44.36.D03.1.pb.heavy.1.raw 1098
cgtatcgcctccctcgcgccatcagacagtatatacacgaccggtgctcgatttagctgcgtcacgatctctcttgggggagagcggagccccagcccccagaattcccaggtgttttcatttggtgattcagccactgaacacagaggactcaccatggagttcgggctgaagctggttttccttgttgttattttacaaaggtgtccagagtgaagtgcagttggtggagtccgggggagacttgtccagcctggagggtccctgagacctctcctgtgtcgcctctgattcaccatcagtgaccacctatatggacctcgggtccgccaggctccagggaggggcctggagtggcttggccgcagtaaaaaacaaaagttgccagctttatcagcagagtacgccggcgtctgtgaaagccagattcaccctcctcaagagatgacttcaagaactcattgattctgcgaatgactaacctgaaaaccgaggagcagacggcgcatgtattattgtgttgtgtttatatcaggaactgtccctggggccagggaaccctggtcaccgtcctcctcagcctccaccaacgggccccatcggtcttcccccctggcgccctgctccaggagcacctccgagagcacagcggcctgggctgcctggtcaaggactacttcctatatactggtctgagcgggctggcaaggcgcatag

SEQ ID NO: 789834 - DNA, 699 bp, Homo sapiens
  misc_feature: 1116.44.55.E11.1.pb.heavy.1.raw 1116
ctatgcgccttgccagcccgctcagacagtatataggaagtagtccttgaccaggcagccagggccgctgtgcccccagaggtgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctgaattgtccctggagatggtgaatcggcccttcacggagtctgcgtagtatgtgaaatcaccagtataaatgactgagacccactccagccccttccctggagcctggcggacccaactcatgtagttgctgctgacggtgagccagaggctgcacaggagagtctctgggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccccaaacccaacgtgcgagtgctaaatcgagcaccggtcgtgtatatactgtctgatggcgcgaggaggcgatacg

SEQ ID NO: 789835 - DNA, 659 bp, Homo sapiens
  misc_feature: 1155.44.38.D05.1.pb.heavy.1.raw 1155
cgtatcgcctcctcgcgccatcagacagtatatacacgaccggtgctcgattagtatctgatagttgggtttgggggaagaggaagactgacggtcctcccaggagttcaggtgctgggcaccttggtacggggaggtgtgtcacaagattgggctctgggcaccgtgggcatggggaggcttagttcagcctggggggtccctgagactctcctgtgcagcctctgattcaccttcagtagctactggatgcactggtccgccaagctccagggaaggggctggtgtgggtctcacgtattaatagtgatgggagtagcacaagctacgcggactccgtgaaagggccgattcaccatctccagagacaacgccaagaacacgctgtatctgcaaatgaaacagtctgagagccgaggacacggctgtgtattactgtgcaagagccggtgcggagttcggggagttgcatactactactacggtatggacgtctggggccaaggaccacggtcaccgtctcctcagcttccaccaagggcccatcggtcttcccctggcgccctgctcaggagcacctctgggggcacagcggccctgggctgcctggtcaaggactacttcctatatactgtctgagcgggctggcaagcgcatag

SEQ ID NO: 789836 - DNA, 723 bp, Homo sapiens
  misc_feature: 1181.44.62.F07.1.pb.heavy.1.raw 1181
ctatgcgccttgccagcccgctcagacagtatataggaagtagtccttgaccaggcagcccagggccgctgtgctctcggaggtgctcctggagcagggcgccagggggaagaccgatgggcccttggtggaggctgaagagacggtcaccactgtcccccggccccaagtactaaaggtgtcatggggggtcaccgtggtcctggctttcaaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagacccactccagtcccctccctggaagcccggcggacccaggtcatgccataggcactaaaggtgaatccagaggccgcacaggaagagggtcagggacctcccaggccgaatcaggccccccccagactccaacaactgcacttccacacacgacacccttttaaaaaagccacaagaaaaaggccagctcagcccaaactccatggagacttctctcctgttcggtccctggtcaccaaatgaagacacctgaaaattcccagggctgggctcctctctcagagctcccctttccctttatgcgactactaaatcgagcaccggtcgtgtatatactggtctgcatgggcgcgagggaggcgatacg

SEQ ID NO: 789837 - DNA, 692 bp, Homo sapiens
  misc_feature: 1193.44.27.C05.1.pb.heavy.1.raw 1193
cgtatcgcctccctcgcgccatcagacagtatatacacgaccggtgctcgatttagacgcgatcgaagggtttggggggaagaggaagtcgccggtgtttccactcggtgatcatcactgaacacagaggactcaccatggagtttgggctgagcctgggttttcctcgttgccctcttaagaggtgtcatgtgtcaggtgcaattcgtggagtctgggggaggcgtggccccagtagggggggtccctgagactctcctgtgcagcctctggattcaccttcgataattggaatatgcagtgggtccgccaggctccaggcgaggggctggagtgggtgcaggtgtgtcatttcatggaggaaatcaagtctacggtgattccgttgagggccgattcaccatctccagagacaattcccgagaacacagtgtctcttcaaatgaacagcctgagacctcaggacacggccgtgtatttttgtgcgagactatctgtttccaaaatcggttcattcgacgcctggggccagggaacgcctggtcaccgtctcctcggcctccacaagggcccatcggtcttcccctggcgccctgctccaggagcacctccgagagccacagccggccctgggctgcctggtcaaggactacttcctatatactgtctgagcgggctggcaaggcgcatag

SEQ ID NO: 789838 - DNA, 712 bp, Homo sapiens
  misc_feature: 1201.UNK.UNK.UNK.pb.heavy.1.raw 1201
cgtatcgcctccctcgcgccatcagacagtatatacacgaccggtggctcgatttagctgcgtcacgatctctctttggggagctctgagagcggagccccagccccagaattcccaggtgtttttcatttggtgatcagcactgaacacagaggactcaccatggagttcgggctgagctgggtttttccttgttgttattttacaaggtgtccagagtgaagtgcagttggtggagtccgggggagacttggtccagcctggagggtccctgagactctcctggtgtcgcctctggatttcaccatcagtgaccactatatggactgggtccgccaggctccagggaaggggctggagtggctggccgcagtaaaaaccaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaaactgtccactggggccagggaaccctggtcaccgtctcctcagcctccaccaaggcccatcggtcttccccctggcgccctgctccaggagcacctccgagagcacagcggccctgggctgccctggtcaaggactacttcctatatactgtctgagcgggctggcaaggcgcatag

SEQ ID NO: 789839 - DNA, 695 bp, Homo sapiens
  misc_feature: 1219.44.45.E01.1.pb.heavy.1.raw 1219
ctatgcgccttgccagcccgctcagacagtatataggaagtagtccttgaccaggcagcccagggccgctgtgcttctcgggaggttgctcctggagcagggcgccaggggggataaagaccgatgggcccttggtggaggctgaggagacggtgaccagggctccctggccccagtagaaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtcggacgcaacacaggaggagtctcagggacgtccaggctggaccacggcctcccccagactccaccagctgaacctgacactggacacctcttaaaagagcaacgaggaaaaacccagctcagcccaaaatccatggtgagtcctctgtgttcagtgctgatcaccgaatggaaacaccgccgacttctagtgctgggctcctctcccagcccctttcccttactgactcactaaatcgagcaccggtcgtgatagtatagactgatggcgcgagggaggcgatacgatc

SEQ ID NO: 789840 - DNA, 716 bp, Homo sapiens
  misc_feature: 1242.44.70.G04.1.pb.heavy.1.raw 1242
ctatgcgccttgccagcccgctcagacagtatataggaagtagtccttgaccaggcagccagggccgctgtgctctcggaggtgctcctggagcagggcgccagggggaagacccgatgggcccttggtggaggctgaggagacggtgaccagggtcccctggccccagtcatgccgcccggtaataaactactaccaccccttccgatcctcgcacagtaatacagagccggagtcctcgactctccaggctgaccatttccaagtacacaatgttccggggaattgtctctggagatggtgaatcggcccttcacggagtctgcataatattcagaacttccatcatgtgctataactgccaaccactcccggccccttgcctggagcctggcggacccgtgcatgccagaaccactgaaactaaatccagaggcttcacaggagagtctcaggacctcccaggctggaccacgcctccccagactccaccaggtgcacctgacagtggacacctcttaaagagagcacacgagaaaacccagctcagcccaaactccatggtgagtcctctgtgtttcagtgctgatcaccgaatggaaacaccgccgacttctagtgctgggcctcctctccagaccctttcccttcacactacactaaatcgagcaccggtcgtgtatatactgtctgatggcgcgagggagggcgatacg

SEQ ID NO: 789841 - DNA, 604 bp, Homo sapiens
  misc_feature: 1257.44.36.D03.1.pb.heavy.1.raw 1257
cgtatcgcctccctcgcgccatcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaaatcctacagtacatctctgaagagcagtttaaccatctccaaggacacctccaaaaggcaggtgtctttagtatgaccaacatggaccctgcggacacaggcacatattactgtgcacgggtaatgcggaaagaaacagctggtttctgtattataagtcttaccatctggacgtctggggcaaaggaccacggtcaccgttcctcagcttccaccaagggcccatcggtcttccccctggcgccctgctccaggagcacctctggggcacagcggccctgggctgcctggtcaaggactacttcctatatactggtctgagcgggctggcaaggcgcatag

SEQ ID NO: 789842 - DNA, 700 bp, Homo sapiens
  misc_feature: 1259.44.27.C05.1.pb.heavy.1.raw 1259
cgtatcgcctccctcgcgccatcagacagtatatacacgaccggtgctcgatttagacgcgatcgaagggtttggggcctgggagacgagcccagcactggaagtcgccggtgtttccactcggtgatcatcactgaacacagaggactcaccatggagtttggctgagctgggttttcctcgttgccctcttaagaggtgtcatgtgtcaggtgcaattcgtggagtctgggggaggcgtggcccagtaggggggtcctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctgggccagggaaccctggtcaccgtctcctcggcctccaccaagggcccatcggtcttccccctggcgccctgctccaggagcacctccgagagcacagcggcctgggctgcctggtcaaggactacttcctatatactgtctgagcgggctggcaaggcgcatag

SEQ ID NO: 789843 - DNA, 680 bp, Homo sapiens
  misc_feature: 1281.UNK.UNK.UNK.pb.heavy.1.raw 1281
ctatgcgccttgccagcccgctcagacagtatataggaaagtaagtccttgaccaggcagcccagggccgctgtgccccagaggtgctcctgggcagggcgccaggggaagaccgatgggcccttggtggaagctgaagagacggtgaccattgtcccctggccccaaatatcaatgcatcgacgtccccaggatcgcctggcgcagtaatagacgcctgtgtcgtcgggtctcaggttgctcatttgtaaatgcgccaacactgtggagtcatcccttgagacggtgaatcttcccttcacagacgcggcgtactctttactctccaccataacgtttcattctgacgaaagtgatccactcaagccccttccctggagcctgacggacccaggccaagtgataatcactaagactgaatcctgagactacacaggagagtctcagagaccgccctggctgtgcaagcccccccccgactccgccagtcgcccctcgcacctggacaccttctaaaaaactacaaggaaaatcaagattagcccaaactccatggttggtgtctgtgctcagtgctgatcaccaagtggaaactcctgggaatctcacggctggcggctcctctctcttgcgacgacactaaaatcgagcaccggtcggtatatactgtctgatggccg

SEQ ID NO: 789844 - DNA, 711 bp, Homo sapiens
  misc_feature: 1307.44.55.E11.1.pb.heavy.1.raw 1307
cgtatcgcctccctcgccgccatcagacagtatatacacgaccggtgctcgattttagcactcgcacgtttgggtttggggagaggagcccagcactgggattccgaggtgtttccattcggtgatcagcactgaacacagaggactcaccatggagtttttggctgagctgggttctccttgttggacttttaaaaaggtgtccagtgtgaggtgcggctgatggagtctggaggaggcttagtccagcctgggggggtcccagagactctcctgtgcagcctctggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacaacggcgtctattactgttgccgagacaagtcggcgcttcggagtggttattattcgtttgacttctggggccagggaaccctggtcaccatcgcctccgcctccaccaagggcccatccggtcttccccctggcaccctcctccaagagcacctctgggggcacagcggccctgggctgcctggtcaaggactacttcctatatactgtctgagcgggctgcaaggcgcatag

SEQ ID NO: 789845 - DNA, 634 bp, Homo sapiens
  misc_feature: 1317.UNK.UNK.UNK.pb.heavy.1.raw 1317
ctatgcgcctatgccagccagctcagacagtatataagggaagtgggtccttgaccaggcagcccagggccgctgtgcccccagaggtgctcctggagcagggcgccagggaagaccgatggcccttggtgaagctgaggagacagtgacagggtgccacggcccatagattgaaagaccagtctcgcctcgcacggaaataacggccgtgtccgcggcggtcacggaggtcagtttcagggagaagcggtcatgacgtgtccctcgaaatggtgagacgactcttgaggacgagagtagtacgtcgcccagtataatgatgtcaccaatccactcattcccctccctggggctgccggatccgcccaagaatgatcagaactgatgaaactccagagacagtgcagatgagagacagggtcccgaaggcctcaccagtcctgggcccgaccctgcagctgcactgggacaggacccatctgggagctgccaccagcagaggaaaaaccacaggtgcttcatgttcttgcacaggagtccttgactctcaaaaagcatcccaaaacccaagtcatagcactaaaatcgagcaccggtcgtgtatatactgtctgatgggcgaggaggcgatacg

SEQ ID NO: 789846 - DNA, 673 bp, Homo sapiens
  misc_feature: 1400.44.12.B01.1.pb.heavy.1.raw 1400
ctatgcgccttgccagcccgctcagacagtatataggaagttagtccttgaccaggcagccagggccgctgtgcccccagaggtgctcttggaggagggtgccagggggaagaccgatgggcccttggtggaggctgaggagacggtgaccagggttccctggcccccagtggtcaaagtagttggtgacgaacttgccctactctcgcacagtaatacacggccgtgtcccgcggcggtcacagagctcagcttcaagggagaactggttcttggacgtgtctactgatatggtgactcgactcttgagggacgggttgtagtaggtgctcccactataatagatactcccaatccactccagccccttccctgggggctggcggatccagccccagtagtaactactactgctgatggagccaccagagacagtgcaggtgaagggacagggtctccgaaggcttcaccagtcctgggcccgactcctgcagctgcagctgggacaggacccatctgggagccgccaccaggcaggaggaagaaccacaggtgcttcatgttcttgcacaggaggtccatggactctcagaaagcccccgcggaatctacactactaaatcgagcaccggtcgtgtatatactgtctgatggcgccgagggaggcgatacg

SEQ ID NO: 789847 - DNA, 662 bp, Homo sapiens
  misc_feature: 1410.44.36.D03.1.pb.heavy.1.raw 1410
agtagtccttgaccaggcagcccagggccgctgtgctctcggaggtgctcctggagcagggcgccagggggaagaccgatgggccttggtggaggctgaggagacggtgaccagggttcctggccccagtggacagttcctgatataaacacaacacaataatacatgcccgtgtcctcggttttcgggttagtcattcgcagaatcaatgagttcttgaagtcatctcttgagaggggtgaatctggctttcacagacgcggcgtactctgtgataagctggcaactttgttttttactgcggccaagccactccagccccttccctggagcctggcggacccagtccatatagtggtcactgatggtgaatccagaggcgacacaggagagtctcagggaccctccaggctggacaagtctcccccggactccaccaactgcacttcactctggacaccttgtaaaataacaacaaggaaaacccagctcagcccgaactccatggtgagtcctctgtgttcagtgctgatcaccaaatgaaacacctgggaattctggggctgggctccgctctcagagctccccaagagagatcgtgacgcagctaaatcgagcaccggtcgtgtatatactgtctgatggcgcgaggaggcgatacg

SEQ ID NO: 789848 - DNA, 714 bp, Homo sapiens
  misc_feature: 1422.44.56.F01.1.pb.heavy.1.raw 1422
cgtatcgcctccctcgcgccatcagacagtatatacacgaccggtgctcgatttagcagacgtctgaacacacaaagggggagctctgggagaggagccccagccgtgagatttccaggagtttccacttggtgatcagcactgagcacagaccaccaaccatgggagtttgggctaatcttgattttccttgtagttttttttagaaggtgtccagtgcgaggggcgactggcggagtcggggggggggcttggcacagccagggcggtctctgagactctcctgtgtagtctcaggattcagtcttagtgattatcacttggcctgggtccgtcaggctccaggaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttgggccaggggacaatggtcaccgtctcttcagcttcaccaagggcccatcggtcttcccctggcgccctgctccaggagcacctctggggcacagcggccctgggctgcctggtcaaggactacttcctatatactgtctgagcgggctggcaaggcgcatag

SEQ ID NO: 789849 - DNA, 667 bp, Homo sapiens
  misc_feature: 1438.UNK.UNK.UNK.pb.heavy.1.raw 1438
cgtatcgcctccctcgcgccatcagacagtatatacacgaccggtggctcgatttagtagtgtagattccgcgggggctttctgagagtcatggacctcctgtgcaagaacatgaagcacctgtggttcttcctcctgctggtggcggctcccagatgggtcctgtcccagctgccagctgcaggagtcgggcccaggactggtgaagccttcggagaccctgtccctcacctgcactgtctctggtggctccatcagcagtagtagttactactggggctggatccgccagccccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttcccctggcaccctcctccaagagcacctctgggggcacagcggccctgggctgcctggtcaaggactacttcctatatactgtctgagcgggctggcaaggcgcatag

SEQ ID NO: 789850 - DNA, 617 bp, Homo sapiens
  misc_feature: 1453.UNK.UNK.UNK.pb.heavy.1.raw 1453
ctatgcgccttgccagcccgctcagacagtataataggaagtagtcttgaccaggcagcccagggccgctgtgcccccagaggtgctcctggagcagggcgccagggggaagaaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaaatggtgagacgactcttgagggacggagagtagtacgtcgccccagtataatggatgtcaccaatccactccattcccctccctgggggctgccggatccagccccagaatgatcagaactgatggaaactcagagacagtgcagatgagagcagggttcccgaaggcctcaccagtcctggcccgactcctgcagctgcacctggacaggacccatctgggagctgccaccagcaggaggaaaaaccacaggtgttcacccctgccccaatccctaatcacgtgtactaaatcgagcacggtcgtgtatatactgtctgatggcgcgaggaggcgatacg

SEQ ID NO: 789851 - DNA, 730 bp, Homo sapiens
  misc_feature: 1458.UNK.UNK.UNK.pb.heavy.1.raw 1458
ctatgcgccttgccagcccgctcagacagtatataggccggagtagtccttgaccaggcagcccaggggccgctgtgctctcggaggtgctcctggagcagggcgccagggggaagaccgatgggcccttggtgggaggccgagagagacggtgaccagggttccctggccccaggcgtcgaatgaaccgattttggaaacagatagtctcgccacaaaaatacacggccggtgtcctgaggtctcaggctgttcatttgaagagacactgtgttctcggaattgtctctggagatggtgaatcggccgctcacgcgaatcaccggtagacttgatttcctcatgaaatgacacacctgccacccactccccagccccctcgcctggagcctgggcgaccaactgcatattccaattatcgaaggtgaatcagaggctgcacaggagagttctcaggtacccccctactggggcccacgcctcccccagactccacgaattgcaacctgacacatgacacctcttaagagggcaacgaggaaaacccagctcagcccaaactccatggtggagtcctctgctgttcagtgatgatcaccgagtggaaacaccggcgacttccgcagtgcctgggctcgtctcccaggcccccaaacccttccgatcggcgtctaaatcgagccaccgggtcgtgtatatactgtctgatggcgcgagggagggcgatacg

SEQ ID NO: 789852 - DNA, 665 bp, Homo sapiens
  misc_feature: 1484.44.12.B01.1.pb.heavy.1.raw 1484
ctatgcgccttgccagcccgctcagacagtatataggaagtagtccttgaccaggcagcccagggccgctgtgccccagaggtgctcttggaggagggtgccagggggaagaccgatgggcccttggtggaggctgaggagacggtgaccagggttccctggccccagtggtcaaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacccatctgggagccgccaccagcaggaggaagaaccacaggtgcttcatgttcttgcacaggaggtccatgactctcagaaagcccccgcggaatctacactactaaatcgagcaccggtcgtgtatatactgtctgatggcgcgagggaggcgatacg

SEQ ID NO: 789853 - DNA, 606 bp, Homo sapiens
  misc_feature: 1507.UNK.UNK.UNK.pb.heavy.1.raw 1507
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcaccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccagatggccgctagcgggttccgcagcttttgacctggaccagggtgcatagcctgcccagccttc

SEQ ID NO: 789854 - DNA, 726 bp, Homo sapiens
  misc_feature: 1512.44.33.C11.1.pb.heavy.1.raw 1512
cgtatcgcctccctcgcgccatcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaaggctggtggagtctgggggaggcgtggtccagcctgggaggtccctgagactctcctgtgtagcgtctggattcaccttcaacagacatggcatgcactggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagctccaccaagggcccatcggtcttccccctggcaccctcctccaagagcacctctgggggccacagcggccctgggctgcctggtcaaggactacttcctatatactgtctgagcgggctggcaaggcgcatag

SEQ ID NO: 789855 - DNA, 568 bp, Homo sapiens
  misc_feature: 1519.44.78.H01.1.pb.heavy.1.raw 1519
cgtatcgcctccctcgcgccatcagacagtatatacacgaccggtgctcgattagtgtgagtagtttgggttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttcccctggcgcctgctccaggagcacctccgagagcacagcggccctgggctgcctggtcaaggactacttcctatatactgtctgagcggctggcaaggcgcatag

SEQ ID NO: 789856 - DNA, 696 bp, Homo sapiens
  misc_feature: 1520.44.36.D03.1.pb.heavy.1.raw 1520
ctatgcgccttgccagcccgctcagacagtatataggaagtagtccttgaccaggcagcccaggccgctgtgctctcggaggtgctcctggagcagggcgccagggggaagaccgatgggcccttggtggaggctgaggagacggtgaccagggttcctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaacttgtttttactgcggccaagccactccagccccttccctggagcctggcggacccagtccatatagtggtcactgatggtgaatccagaggcgacacaggagagtctcagggacctccaggctggaccaagtctccccggactccaccaactgcacttcactctggacaccttgtaaaataacaacaaggaaaacccagctcagcccgaactccatggtgagtcctctgtgttcagtgctgatcaccaaatgaaacacctggaattctggggctgggctccgctctcagagctccccaagagagatcgtgacgcagctaaatcgagcaccggtcgtgtatatactgtctgatggcgcgaggaggcgatacg

SEQ ID NO: 789857 - DNA, 683 bp, Homo sapiens
  misc_feature: 1528.44.74.G08.1.pb.heavy.1.raw 1528
cgtatcgcctccctcgcgccatcagacagtatatacacgaccggtgctcgatttagtagctctatcagggggagcatcacataacaaccacattcctcctctaaagaagcccctggagcacagctcatcaccatggactggacctgaggttcctctctttgtggtggcagcagcaacaggtgtccagtccctggtgcaactggtgcagtctggactagaatgccgcaaccttgtcctcggtgaccctttcctgcacgcctctggaagtactaccagttccactacttataccatcaactgggtgcgccaggcccctggacaagggcttgagtggatggtggaatcatccctcttttggctcactcacctacgcacgagacttccggggcagaattacgattaccgcggacaagtccacagacacagtctccatgacaatgagttctttgaaatccgacgacacggccgtcactactgtgcgagaggtccgtaccccagctcgcatggagcctttgagatctgggggcagggaaccctggtcattgtcacctcagcttccaccaagggccatcggtcttcccctggcgccctgctcaggagcacctctggggcacagcggccctggctgcctggtcaaggactacttcctatatactgtctgagcgggctggcaaggcgcatag

SEQ ID NO: 789858 - DNA, 603 bp, Homo sapiens
  misc_feature: 1536.UNK.UNK.UNK.pb.heavy.1.raw 1536
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctagggatgggataggaaatagaatccacccctatcaccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagatggccgcttgctgtgggcattgcaagctgggtttgcagcattgtgcatgctagacgacaatatgaatctgcgggacccctagtggccagatggccgctagcgggttcgcagcttttgacctggaccagggtgcatagcctgcccagccttc

SEQ ID NO: 789859 - DNA, 692 bp, Homo sapiens
  misc_feature: 1586.44.36.D03.1.pb.heavy.1.raw 1586
cgtatcgcctccctcgcgccatcagacagtatatacacgaccggtgctcgatttagctgcgtcacgatctctcttggggagctctgagagcgagccccagcccgaattcccaggtgttttcatttggtgatcaggcactgaacacagaggactcaccatggagttcggctgagctgggttttccttgttgttatttacaaggtgtccagagtgaagtgcagttggtggagtccgggggagactggtcagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactacctgaaaacgaggacacgggcatgtattatttgtgttgtgtttatatcaggaactgtccactggggcaggaaccctggtcaccgtctcctcagcctccaccaagggcccatcgtctccccctggcgccgctccaggagcacctccgagagcacagcggccctgggctgcctggtcaaggactacttcctatatactgtctgagcgggctggcaaggcgcatag

SEQ ID NO: 789860 - DNA, 691 bp, Homo sapiens
  misc_feature: 1592.UNK.UNK.UNK.pb.heavy.1.raw 1592
cgtatcgcctccctcggcgccatcagacagtatatacacgaccggtgctcgatttagctgcggtcacgatctctcttgggagctctgagagcggagcccagcccagaattcccaggtgttttcatttggtgatcagcactgaacacagagactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgacactatatggactgggtccgcaggctccagggaggggctggagtggcttggccgcagtaaaaacaagttgccagctttatcacagagtacggccgcgtctgtgaaagccagatcaccctctcaagagatgacttcagaactcattgattctgcgatgactaacctgaaaaccgaggacacggcatgtattattgtgttgtgtttatatcagactgtccactggggccagggaaccctggtcaccgtctcctcagcctccaccaagggcccatcggtcttccccctggcgccctgctccaggagcactccgagagcacagcggccctgggctgcctggtaaggactacttcctatatactgtctgagcgggctggcaaggcgcata

SEQ ID NO: 789861 - DNA, 650 bp, Homo sapiens
  misc_feature: 1599.UNK.UNK.UNK.pb.heavy.1.raw 1599
ctatgcgccttgccagcccgctcagacagtatataggaagtagtccttgaccaggcagcccagggccactgtgcccacagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcaggagaagcggttcatggacgtgtccctcgaaatggtgagacgactcttgagggacggagagtagtacgtcgccccagtataatggatgtcacaatccactccattccctccctggggctgccgggatccagccccaagaatgatcagaactgatggaaactccagagacagtgcagatgagagacagggttcccgaaggcctcaccagtcctggcccgactcctgcagctgcacctgggacaggacccatctgggagctgccaccagcaggaggaaaaaaccacaggtgcttcatgttcttgcacaggaggtccttgactctcagaaagcatccccaaacccaagtctatagcactaaatcgagcaccgtcgtgtatatactgtctgatggcgcgagggaggcgatacg

SEQ ID NO: 789862 - DNA, 711 bp, Homo sapiens
  misc_feature: 1605.44.36.D03.1.pb.heavy.1.raw 1605
ctatgcgccttgccagcccgctcagacagtatataggaagtagtttccttgaccaggcagcccagggccgctgtgctctcggaggtgctcctggagcaggggcgccagggggaagaccgatgggcccttgggtggaggctgaggagacggtgaccagggttccctggccccagtggaccagttcctgatataaacacaacacaataatacatgcccgtgtcctcggttttcaggttagtcattcgcagaatcaatgagttcttgaagtcatctctttgagagggtgaatctggctttcacagacgcgggcgtactctgtgataaagctggaactttgtttttactgcggccaagccactccagccccttccctggagcctggcgggacccagtccatatagtggtcactgatggtgaatccagaggcgacacaggagagtctcagggaccctccaggctggaccaagtctccccggactccaccaactgcacttcactctggacaccttgtaaaataacaacaaggaaaacccagctcagcccgaactccatggtgagtcctctgtgttcagtgctgatcaccaaaatgaaaacacctgggaattctgggctggggctccgctctcagagctccccaagagagatcgtgacgcagctaaatcgagcaccggtcgtgtatatactgtctgatggcgcgagggaggcgatacg

SEQ ID NO: 789863 - DNA, 642 bp, Homo sapiens
  misc_feature: 1627.UNK.UNK.UNK.pb.heavy.1.raw 1627
cgtatcgcctccctcgcgccatcagacagtatatacacgaccggtgctcgatttagtagtacacggggatagcattgggttggtccagtgtcgtgaacacctgtggtttttcctcctgctggtggcaggctccagatgggtcctgtcccagctgcagctgcaggagtcgggcccaggactggtgaggcttcggggaacctgtctctcactctgcactgtctctgggagtttccatcaggttcgatcattcttgcggctggatccggcagccccccaggaagggggaatggagtggattgggagcatccattatactggggcgacgtactactctccgtccctcaagagtcgtctcaaccatttcgagagacacgtccatgaaccgcttctccctgaactgactctgtgaccgccgcggacacggccgtttatttctggtgcgaggcagactggggtcgtttcaatctatgggccgtgggcaccgccggaacactggtgcgtctctcagccttccaccaagggcccatcggtcttccccctggcccctgctccagagcacctctgggggcacagcggccctggcgctgcctggtcaaggactacttcctatatactgtctgagcgggctggcaaggcgcatag

SEQ ID NO: 789864 - DNA, 708 bp, Homo sapiens
  misc_feature: 1641.44.36.D03.1.pb.heavy.1.raw 1641
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactccattgattctgcgaatgactaacctgaaaaccgaggacacggggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 789865 - DNA, 608 bp, Homo sapiens
  misc_feature: 1643.UNK.UNK.UNK.pb.heavy.1.raw 1643
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttactttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 789866 - DNA, 691 bp, Homo sapiens
  misc_feature: 1676.UNK.UNK.UNK.pb.heavy.1.raw 1676
cgtatcgcctccctcgcgccatcagacagtattacacgcccggtggctcgatttagacgcgatcgaagggtttggggagccctggaagagacgagccccagcactggaagtcgccggtgttccactcggtgatcatcactgaacacagaggacttcaccatggagtttggctgagctggttttcctcgttgccctcttaagaggtgtcatgtgtcagtgcaattcgtggagtctgggggaggcgtggcccagtaggggggtcctgagactctcctgtgcagcctctgatcaccttcgataattggaatatgcagtggttccgccaggtccaggcgagggctgagtgggtggcaggtgtgtcattttcatggaggaaatcaagtctacggtgattccgttgagggccgattcaccatctcagagacattccgagaacacagtgtctcttcaaatgaacagcctgagacctcaggaaccggccgtgtatttttgtgcgagactatctgtttcaaatcggttcattcgacgcctgggccagggaaccctggtcaccgtctcctcgcctccaccaagggcccatcggtcttccccctggcgcctgctccaggagcacctcgagagcacagcggccctgggctgcctggtcaggactacttcctatatacgtctgagcgggctgcaaggcgcatag

SEQ ID NO: 789867 - DNA, 676 bp, Homo sapiens
  misc_feature: 1707.44.53.E09.1.pb.heavy.1.raw 1707
cgtatcgcctccctcgcgccatcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtctgggggagtttggtaaagcctgggagtcccttagactctcctgtgcagcctctggattcactttcagtaacgcctggatgacctgggtccgccaggctccaggaagggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaaggcccatcggtcttcccctggcgccctgctccaggagcacctccgagagcacagcggccctggctgcctggtcaaggactacttcctatatactgtctgagcgggctggcaaggcgcatag

SEQ ID NO: 789868 - DNA, 677 bp, Homo sapiens
  misc_feature: 1728.44.71.G05.1.pb.heavy.1.raw 1728
cgtatcgcctcccctcgcgcatcagacagtatatacacgaccggtgctcgatttagtgtcgtcgcaagagagaggagcccagccctggggactgaacagagagaactcaccatgggagttttgggctgagctggctttttcttgtggctgttttaaaaggtgtccagtgtgaagtgcagctgttggagtcggggaggcttggtacagccggggggggtccctgacactctcctgtgcagccctctggattcgccttttatacctatgccatgatctgggtccgttcaggccccagggaaggggcggagtgggtctcatccattactggtggtagtgccacaaatgtcgcagactccgtgaagggccgcttcatcgtctccagggacaattccaagaatacggtgtttctgcagatgaagagcctgcgagtggacgacacggccctttattactgtgccagagggtcgcagaagttacaacaatacaagtattactactacatggacgtctggggcaaaggaccccggtcaccgtctcctcagcctccaccaagggcccatcggtcttccccctggcaccctctccaagagcacctctgggggcacaggcggccctgggctgcctggtcaaggactacttcctatataactgtctgagcgggctggcaaggcgcatag

SEQ ID NO: 789869 - DNA, 675 bp, Homo sapiens
  misc_feature: 1805.UNK.UNK.UNK.pb.heavy.1.raw 1805
cgtatcgcctcctcgcgccatcagacagtatatacaacgaccggtgctcgatttagtgtcgtcgcaagagagaggagccccagccgtggattcccaggagtttccacttggtgatcagcactgagcacagccaccaaccatggagtttggctaatctgatttccttgtagttttttagaggtgtccagtgcgagggcgacctggcggagtcgggggggggcttggcacagccaggcgtctctgagactctctgtgtagtctcaggattcagtctagtgattacactggcctgggtccgtcaggctccagggaaggggctgagtggatcactttcgtcagaatgaaacgtatggtggaagtaaagagtacgccgcgtctgtgaagggaagattcaccgtctcaagggatgactccaacagtgtggccatttacaaatgagcaacctgagacgacgacacaggcgtctattactgcgccaggcgatcctgggacgtcgaatgcatttgatatttggggccaggggacaatggtcccgtctcttcgcttccacaggggcccatcgtcttccccctggcgccctgctccaggagcacctctgggggccacagcggccctgggctgcctggtcaaggaactactcctataactgctgagcgggctggcaaggcgccatag

SEQ ID NO: 789870 - DNA, 707 bp, Homo sapiens
  misc_feature: 1806.44.56.F01.1.pb.heavy.1.raw 1806
cgtatcgcctccctcgcgccatcagacagtatatacacgaccggtgctcgatttagcagacgtctgaacacacaaaggggagctctggagaggagccccagccgtgagattcccaggagtttccacttggtgatcagcactgagcacagacaccaaccatggagtttgggctaatcttgattttccttgtagttttttttagaaggtgtccagtgcgaggggcgactggcggagtcgggggggggcttggcacagccagggcggtctctgagactctcctgtgtagtctcaggattcagtcttagtgattatcacttggctgggtccgtcaggctccagggaaggggcttgagtggatcactttcgtcagaatgaaacgttatggtggaagtaaagagtacgccgcgtctgtgaaggaagattcaccgtctcaaggatgactccaacagtgttggccatttacaaatgagcaacctgagaccgacgacacaggcgtctattactgcgccaggcgatcctgggacgtcgatgcatttgatatttggggccaggggacaatggtcaccgtctcttcaagcttccaccaagggcccatcggtcttccccctggcgccctgctccaggagcacctctggggcacagcggccctggctgcctggtaaggactacttcctatatactgtctgagcgggctggcaggcgcatag

SEQ ID NO: 789871 - DNA, 673 bp, Homo sapiens
  misc_feature: 1819.UNK.UNK.UNK.pb.heavy.1.raw 1819
ctatgcgcctgccagcccgctcagacagtatataggaagtagtccttgaccaggcagccaggccgctgtgccccagaggtgctcttggaggagggtgccaggggaagaccgatgggccttggtgagcggaggcgacggtgaccaggttcctggcccagaagtcaaacgaatataaccactcgagcgccgacttgtctcgcacagtaatagacggccgtgtcgtcgcctctcaggttgttcattgaagataaacgtgttcctggaattgtccctggagatggtgaatcggccttcacggagtctgcgtagtatgtgaaatcaccagtataatgactgagacccactccagccccttcctggagcctggcggacccaactcatgtagtgctgctgacggtgagcccagaggctgcacaggagagtctctggaccccccaggctggactaagctcctccagactccatcagccgcacctcacactggacaccttttaaagtccaacaaggagaacccagctcagccaaactccatggtgagtctctgtgttcagtgctgatcaccgaatggaaacacctcggaatccagtgctggctcctctccccaaaccaacgtgcgagtgctaaatcgagcaccgtcgtgtatatactgtctgatgcgcgaggaggcgatacg

SEQ ID NO: 789872 - DNA, 670 bp, Homo sapiens
  misc_feature: 1828.UNK.UNK.UNK.pb.heavy.1.raw 1828
cgtatcgcctccctcgcgccatcagacagtatatacacgaccgtgctccgatttagctacgactgcaagggaaaggggagagaggagccttagcctggactcaaggcctttccacttgtgacagcactgagcacagaggactcaccatggaattggactgagctggttttccttgttgcattttagaaggtgtccatgtgagtgcaactggtggagtctgggggaggcttggtccagcctgggggtcctgagacccccctgtgcagcctcctggattccaccttagtagttattggatgaactgggtccgccaggctccagggaaggggctggagtgggtggccatcatgagaaagatggaactgagacacactatgtggactctgtgaagggccgattcaccatctccagagacaacgccagaaccactgtatctgcaaatgaacagtctgaggtcgaggacacggctgtgtatattgtgcgggaggcgcgggtggctcttgactactggggtcagggaaccctggtcaccgtctcctcagctcaccaaggcccatcggtctcccctggcgccctgctccaggagcacctccgagagccagcggccctgggctgcctggtcaaggactacttcctatatactgtctgagcgggctggcaaagcgcataa

SEQ ID NO: 789873 - DNA, 695 bp, Homo sapiens
  misc_feature: 1910.44.55.E11.1.pb.heavy.1.raw 1910
ctatgcgccttgccagcccgctcagacagtatataggaagtagtccttgaccaggcagcccaggccgctgtgcccccagagtgctcttggaggagggtgccaggggagacgatgggcctggtggaggcggaggcgacggtgaccagggttccctggcccagaagtcaaacgaataataaccactccgagcgcgacttgtctcgcacagtaatagacggccgtgtcgtcgcctctcaggttgttcatttgaagataaaccgtgttcctggaattgtccctggagatgtgaatcggcccttcacggagtctgcgtagtatgtgaaatcaccagtataaatgactgagacccactccagcccttccctggagcctggcggacccaactcatgtagttgctgctgacggtgagccagaggctgcacaggagagtctctgggaccccccaggctggactaagcctcctccagactccatcagccgcacctcacactggacaccttttaaaagtcaacaaggagaacccagctcagccaaaactccatggtggagtcctctgtgttcagtgctgatcaccgaatggaaacacctcggaatccagtgctggctcctctccccccaaacccaacgtgcgagtgctaaatcgagcaccggtcgtgtgccttatactgtctgatgggcgcgagggaggcgatacg

SEQ ID NO: 789874 - DNA, 658 bp, Homo sapiens
  misc_feature: 1956.44.86.H09.1.pb.heavy.1.raw 1956
ctatgcgccttgccagcccgctcagacagtatataggaagtagtccttgacccaggcagcccagggcccctgtgcccccagaggtgctcctggagcagggcgccaggggaagaccgatgggcccttggtggaagctgaggagacagtgaccagggtgccacggcccccatagattgaaagaccagtctcgcctcgcacagaaataaacggcgtgtccgcggcggtcacgaggtcagtttcagggagaagcggttcatggacgtgtccctcgaaatggtgagacgactcttgagggacggagagtagtacgtcgcccagtataatggatgtcaccaatccactccatttccctccctggggggctgccggatccagccccaagaatgatcagaactgatggaaactccagagacagtgcagatgagagacagggttcccgaaggcctcaccagtcctggcccgactccttgcagctgcaccctgggacaggacccatctgggagctgccaccagcaggaggaaaaaccacaggtgcttcatgttcttgcacagggaggtccttgactctcagaaagcatccccaaacccaagtctatagcactaaatcgagcaccggtcgtgtatatactgtctgatggcgcgaagggaggccgatacg

SEQ ID NO: 789875 - DNA, 705 bp, Homo sapiens
  misc_feature: 1986.44.55.E11.1.pb.heavy.1.raw 1986
ctatgcgccttgccagcccgctcagacagtatataggaagtatgtccttgaccagccgcaagcccagggccgctgtgcccccagaggtgctcttggaggagggtgccaggggaagaccgatgggcccttggtggaggcggaggcgacggtgaccaggttccctggccccagaagtcaaacgaataataaccactccgagcgccgacttgtctcgcacagtaatagacggccgtgtcgtcgcctctcaggttgttcatttgaagataaaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctggaccccccaggctggactaagcctcctccagactccatcagccgcacctcacactggacaccttttaaagtccaacaaggagaacccagctcagcaaaactccatggtgagtcctctgtgttcagtgctgatcaccgaatggaaacacctcggaatccagtgctgggctcctctcccccccaaacccaacgtgcgagtgctaaatcgagcaccggtcgtgtatatactgtctgatggcgcgagggaggcgatacg

SEQ ID NO: 789876 - DNA, 693 bp, Homo sapiens
  misc_feature: 1990.44.55.E11.1.pb.heavy.1.raw 1990
cgtatcgcctccctcgcgccatcagacagtatatacacgaccggtgctcgatttagcactcgcacgttgggtttggggggagaggagcccagcactggattccgaggtgtttccattcgtgatcagcactgaacacagaggactcaccatggagttttggctgagctgggttctccttgttggacttttaaaaggtgtccagtgtgaggtgcggctgatggagtctggaggaggcttagtccagcctggggggtccagagactctcctgtgcagcctctgggctcaccgtcagcagcaactacatgagttgggtccgccaggctccaggaaggggctggagtgggtctcagtcatttatactggtgatttcacatactacgcagactccgtgaaggccgattcaccatctccagggacaattccaggaacacggtttatcttcaaatgaacaacctgagaggcgacgacacggccgtctattactgtgcgagacaagtcggcgctcgagtggttattattcgttgacttctgggccaggaaccctggtcaccgttcgcctccgcctccaccaagggcccatcggtcttcccctggcaccctctccaagagcactctggggcacagcggccctgggctgcctggtcaaggactacttcctatatactgtctgagcgggctggcaaggcgcatag

SEQ ID NO: 789877 - DNA, 656 bp, Homo sapiens
  misc_feature: 2008.44.23.C01.1.pb.heavy.1.raw 2008
ctatgcgccttgccagcccgctcagacagtatataggaagtagtccttgaccaggcagcccaggggccgctgtgcccccagaggtgctcctggagcagggcgccagggggaagaccgatgggcccttggtggaagctgaggagacagtgaccagggtgccacgggccccatagattgaaagaccagtctcgcctcgcacagaaataaacggccgtgtccgcggcggtcacggaggtcagtttcagggagaagcggttcatggacgtgtcccctcgaaatggtgagacgactcttgagggacggagagtagtacgtcgccccagtataatggatgtcaccaatccactccattccctccctgggggctgccggatccagccccaagaatgatcagaactgatggaaactccagagacagtgcagatgagagacagggttcccgaaggcctcaccagtcctgggcccgactcctgcagctgcacctgggacaggaacccatctgggagctgccaccagcaggagaaaaaccacaggtgcttcatgttcttgcacaggaggtccttgactctcagaaagcccccaatccctaatcacgtgtactaaatcgagcaccggtcgtgtatatactgtctgatggccgcgagggaggcgatacg

SEQ ID NO: 789878 - DNA, 716 bp, Homo sapiens
  misc_feature: 2044.44.86.H09.1.pb.heavy.1.raw 2044
cgtatcgcctccctcgcgccatcagacagtatatacacgaccggtgctcgatttagtgctatagacttggttgggagctctgggagaggagccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatgcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgagacacggctgtctactactgtgcgagagatggggctcgtggatacagatatgacatgctctactccaatggtatggacgcctggggccaaggaccacgtcgccgtctcctcagcctcaccaaggcccatcggtcttcccctggcaccctcctccaagagcacctctggggcacagcggccctggctgcctggtcaaggactacttcctatatactgtctgagcgggctgcaaggcgcatag

SEQ ID NO: 789879 - DNA, 731 bp, Homo sapiens
  misc_feature: 2048.44.33.C11.1.pb.heavy.1.raw 2048
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtggtgttcttcgaattgtctctggagatggtgaatcggcccttcacggaatctacataatatttattacttccatcataccatataagtgccacccactccagtccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagagctccccaaacccaacgagctcactctaaatcgagcaccggtcgtgtatattactgtctgatggcgcgagggaggcgatacg

SEQ ID NO: 789880 - DNA, 700 bp, Homo sapiens
  misc_feature: 2051.44.55.E11.1.pb.heavy.1.raw 2051
ctatgcgccttgccagcccgctcagacagtatataggaagtagtccttgaccaggcagccagggccgctgtgccccagaggtgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggccttcacggagtctgcgtagtatgtgaaatcaccagtataaatgactgagacccactccagccccttccctggagcctggcggacccaactcatgtagttgctgctgacggtgagcccagaggctgcacaggagagtctctgggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccccaaacccaacgtgcgagtgctaaatcgagcaccggtcgtgtatatactgtctgatggcgcgagggaggcgatacg

SEQ ID NO: 789881 - DNA, 697 bp, Homo sapiens
  misc_feature: 2065.UNK.UNK.UNK.pb.heavy.1.raw 2065
ctatgcgccttgcccagcccgctcagacagtatataggagtagtccttacaggcagcccagggccgctgtgctctcggaggtgctctggagcagggcgccagggggaagaccgatgggcccttggtggaggccgaggagacggtgacagggttccctggccccaggcgtcgaatgaacgattttggaaacagatagtctcgcacaaaaatacacggccgtgtcctgaggtctcaggctgttcatttgaagagacactgtgttctcggaattgtctctggagatggtgaatcggccctcaaggaatcaccgtagacttgatttcctccatgaaatgacacacctgcaccccactccagcccctcgctggagcctggcggacccactgcatattccaattatcgaaggtggaatccagaggctgcacaggagagtctcagggacccccctactggggcacgcctcccccagactccacgaattgcacctgacacatgacacctcttaagagggcaacgaggaaaaccagctccagcccaaactccatggtgagtcctctgtgttcagtgatgatcacgagtggaacaccggcgacttccagtgctgggctcgttctcccagggctccccaaacccttcgatcgcgtctaatcgagcaccgtcgtgtatatactgtctgatggcgcgaggaggcgatacg

SEQ ID NO: 789882 - DNA, 729 bp, Homo sapiens
  misc_feature: 2101.44.33.C11.1.pb.heavy.1.raw 2101
cgtatcgcctccctcgcgccatcagacagtatatacacgaccggtgctcgattagagtgagctcgttgggtttgggggctgggagaggaaggcccagcaccagaagtcggcggtgtttccagtcggtgatcagcaccgaacacagaggactcaccatggagtttgggctgacctgggttttcctcgttgctcttttaagaggtgtccagtgtcaggtgaaagctggtggagtctgggggaggcgtggtccagcctgggaggtccctgagactctcctgtgtagcgtctggattcaccttcaacagacatggcatgcactgggtccgcccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtcactactgtgcgagagatggggctcgtggatacagatatgacaatgctctactccaatggtatggacgcctggggccaagggaccacggtcgccgtctcctcagcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 789883 - DNA, 700 bp, Homo sapiens
  misc_feature: 2105.44.71.G05.1.pb.heavy.1.raw 2105
ctatgcgccttgccagcccgctcagacagtatatagagaagtagtccttgaccaggcaagcccagggcccgctgtgccccagaggtgctcctgggcagggcgccaggggggaagaccgatgggcctggtggaagctgaagagacggtggaccatttgtccctggccccaaatatcaaatgcaatcgacgtcccaggatcggcctggcgcagtaatagacgccctgtgtcgtcggtctcaggtgctcttgtaaatggccacactgttgggagtcatcccttgagacggttgaatcttcccttcacagacgcggcgtactctttactttccaccataaacgtttcatttctgacgaaagtgatccactcaaccccttccctggagcctgacgggaacccaggccaagtgaaatcactaaagactgaatcctgagactaccacaggagagtctcagaaaaccgccctggcttgtgccaagcccccccccgactccgccagtcgccctcgcactggacaccttctaaaaaactacaaggaaatcaagatagccaaacctccatgttggtggtcctgtgctcagtgctgatcaccagtggaaactcctgggaatctcacggctggggctcctctctcttgcgacgacactaaatcgagcaccggtcgtgtatatactgtctgatggcgcgagggagggcgatacg

SEQ ID NO: 789884 - DNA, 662 bp, Homo sapiens
  misc_feature: 2142.44.86.H09.1.pb.heavy.1.raw 2142
ctattgcgccttgccagcccgctcagacagtatataggaagtagtccttggaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagccggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaaggtccttgactctcagaaaagcatccccaaacccaagtctatagcactaaatcgagcaccggtcgtgtatatactgtctgatggccccgagggaggcgatacga

SEQ ID NO: 789885 - DNA, 733 bp, Homo sapiens
  misc_feature: 2145.44.33.C11.1.pb.heavy.1.raw 2145
cgtatcgcctccctcgcgccatcagacagtatatacacgaccggtgctcgatttagagtgagctcgttgggtttggggagctctgggagaggagcccagcaccagaagtcggcggtgtttccagtcgggtgatcagcaccgaacacagaggactcaccatggagtttgggctgacctgggttttcctcgttgctcttttaagaggtgtccagttcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgaatggaagtaataatattatgtagattccgtgaagggccgatcaccatctccagagacaatttcgaagaacacactatatctggaaatgaatagcctgagagccgaggacacggctgtcctactactgtgcgagagatgggggctcgtggatacagaatatgaccatgctctactccaatggtatggacgcctgggggccaagggaccacggtcgcccgtctcctcagcctccaccaagggcccatcgtctcccccggcaccctcctccaagagcacctctgggggcacagcggccctgggctgcctggtcaaggactacttcctatatactgtctgagcgggctggcaaggcgcatag

SEQ ID NO: 789886 - DNA, 703 bp, Homo sapiens
  misc_feature: 2181.44.36.D03.1.pb.heavy.1.raw 2181
ctatgcgccttgccagcccgctcgacagtatataggaagtagtccttgaccaggcagcccagggccgctgtgctctcggaggtgctcctggagcagggcgccaggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 789887 - DNA, 733 bp, Homo sapiens
  misc_feature: 2201.UNK.UNK.UNK.pb.heavy.1.raw 2201
cgttatcgcctccctcgcgccatcagacagtatataccacggaccggtgctcgatttagagtgagctcgttgggtttggggagctctggagaggagcccagcaccagaagttcggcggtgtttccagtcggtgatcagcaccgaacacagaggactcaccatggagtttgggctgacctgggttttcctcgttgctcttttaagaggtggtccagtgtcaggtgaagctggtgagtctgggggaggcgtggtccagcctgggaggtccctgagactctcctgtgtagcgtctggattcaccttcaacagacatggcatgcactggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggttcgccgtctcctcagcctccaccaagggcccatcggtcttccccctggcaccctctccaagagcacctctgggggcacagcggccctgggctgcctggtcaaggactacttcctatatactgtctgaagcgggctggcaaggcgcatag

SEQ ID NO: 789888 - DNA, 708 bp, Homo sapiens
  misc_feature: 2237.UNK.UNK.UNK.pb.heavy.1.raw 2237
ctatgcgcctgccagcccgctcagacagtatataggaagtagtccttgaccaggcagcccaggccgctgtgcccccagaggtgctcctggagcagggccgccaggggaagacgatgggcccttggtggaagctgaagagacggtgaccattgtcccgtggccccccaaatatcaaatgcatcgaccgtcccaggatcgcctgcgcagtaatagacgcctgtgtcgtcgggtctcagttgctcatttgtaaatggccaacactgttggagtctccttgagacggtgaatcttccttcacagacgcggcgtactctttactccaccataacgtttcattctgacgaaagtgatccactcaagccccttccctggagcctgacggggacccaggccaagtgataatcactaagactgaatcctgagactacacaggagagtctcaggaccgccctggctgtgcaaagcccccccgactcgccagtcgccccctcgcactggacaccttctaaaaactacaaggaaaatcaagattagcccaactccatggtttggtggtctgtgctcagtgctgatcaccaagggaaactcctggaatctcacggctggggctcctctcccagagctcccctttggtgtgtttcagacgtctgctaaatcgagcacgccgttcgtgtatatactgtctgatggcgcgagggaggcgatacg

SEQ ID NO: 789889 - DNA, 707 bp, Homo sapiens
  misc_feature: 2269.44.56.F01.1.pb.heavy.1.raw 2269
cgtatcgcctccctcgcgccatcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagtttttttagaaggtgtccagtgcgagggcgactggcgagtcgggggggcttggcacagccagggcggtctctgagactctcctgtgtagtctcaggattcagtcttagtgattatcacttggcctgggtccgtcaggctccagggaagggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcattgatatttggggccagggacaatggtcaccgtctcttcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 789890 - DNA, 684 bp, Homo sapiens
  misc_feature: 2270.UNK.UNK.UNK.pb.heavy.1.raw 2270
ctatgcgccttgccagcccgctcagacagtatataggaagtagtccttgaccagggcccagggccagggccgctgtgccccagaggtgctcctggagccagggcgccagggggaaagacccgatgggcccttggtggaagctgagggtgacaatgaccagggttccctgccccagatctcaaaggctccatgcgagctggggttacggacctctcgcacagtagtagacggccgtgtcgtcggatttcaaagaactcattgtcatggagactgtgtctgtggacttgtccgcggtaatcgtaattctgcccggaagtctcgtgcgtaggtgagtgagcaaaaagagggatgattccacccatgccactcaaagcccttgtccagggcctggcgcaccagttgatggtataagtagtggaactggtagtacttccagaggccgtgcaggaaagggtcaccgaggaccaaggttgcggcattctagtccccagactgcaccagttgcaaccagggactggacacctgttgctgctgccaccacaaagaggaacctccaggtccagtccatggtgatgagctgtgctcccaggggcttctttagaggaggaatgtggttgtcagtagatctaaatcgagccaccggtcgtgtatatactgtctgatggcgcggagggaggcgatacg

SEQ ID NO: 789891 - DNA, 698 bp, Homo sapiens
  misc_feature: 2273.44.27.C05.1.pb.heavy.1.raw 2273
cgtatcgcctcctcgcgccatcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaatcaagtctacggtgattccgtgagggccgattcaccatctccagagacaattccgagaacacagtggtctcttcaaatgaacagcctgagacctcaggacacgggccgtgtatttttgtgcgagactatctgtttccaaaatcggttcattcgacgcctggggccagggaaccctggtcaccgtctcctcggccttccaccaagggcccatcggtcttccctggcgcctgctccaggagcacctccgagagcacagcggccctggctgcctggtcaaggactacttcctatatactgtctgagcgggctggcaggcgcatag

SEQ ID NO: 789892 - DNA, 707 bp, Homo sapiens
  misc_feature: 2278.UNK.UNK.UNK.pb.heavy.1.raw 2278
cgtatcgcctccctcgcgccatcagacagtatatacacgacggtgctcgatttagcactcgcacgtttgggtttggggggggaggaggagcccagccactgggattcgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctggctcaccgtcagcagcaactacatgagttgggtccgccaggctccagggaaggggctggagtgggtctcagtcatttatactggtgatttcacatactacgcagactccgtgaagggccgattcaccatctccagggacaattcaggaacacggtttatcttcaaatgaacaacctgagaggcgacgacacggccgtctattactgtgcgagacaagtcggcgctcggagtggttattattcgtttgacttctgggccagggaaccctggtcaccgtcgcctccgcctccaccaagggcccatcggtctttcccctggcaccctcctccaagagcacctctgggggcacagcggccctgggctgcctggtccaaggactacttcctatatactgtctgagcggcctggccaaggcgcatag

SEQ ID NO: 789893 - DNA, 703 bp, Homo sapiens
  misc_feature: 2281.44.55.E11.1.pb.heavy.1.raw 2281
ctatgcgccttgccagcccgctcagacagtatataggaagtagtccttgaccaggcagccagggccgctgtgcccccagaggtgctcttggaggagggtgccagggggaagaccgatgggcccttggtgaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagcccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaatcgagcaccggtcgtgatagtataagactgatggcgccgagggaggcgatacg

SEQ ID NO: 789894 - DNA, 663 bp, Homo sapiens
  misc_feature: 2285.UNK.UNK.UNK.pb.heavy.1.raw 2285
ctatgcgccttgccagccgctcagacagtatataggaagtagtccttgaccaggcagcccaggccgctgtgcccccagaggtgctcctggagcagggcgccagggggaagacgatgggcccttggtggaagctgagtgacaatgaccagggttccctgcccccagatctcaaaggctccatgcgagctgggtacggacctctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaaagagggatgattccacccatccactcaagcccttgtccagggcctggcgcaccagttgatggtataagtagtggaactggtagtacttccagagccgtgcaggaaagggtcaccgaggaccaaggttgcggcattctagtcccagactgcaccagttgcaccagggactggacacctgtgctgctgccaccacaaagaggaactccaggtccagtccatgtgatgagctgtgctcccaggggcttctttagaggaggaatgtggttgtcagtagatctaaatcgagcacggtcgtgtatatactgtctgatggcgcgagggaggcgatacg

SEQ ID NO: 789895 - DNA, 505 bp, Homo sapiens
  misc_feature: 2296.UNK.UNK.UNK.pb.heavy.1.raw 2296
ctatgcgccttgccagcccgctcagacagtatataggaagtagtccttgaccaggcagcccagggccgctgtgctctcggaggtgctcctggagcagggcgccagggggaagaccgatgggccctggtggaggctgaggagacggtgaccagggttccctggccccagtggacagttcctgatataaacacaacacaataatacatgcccgtgtcctcggttttcagttagtcattcgcagaatcaatgagttcttgaaagtcatctcttgagagggtgaatctggctttccacagacgcgcggcgtactctgtgataaaagctggcaactttgtttttactgcggccaagccactccagccccttccctggagcctggcggaccccagtccatatagtgggtcactgatggtgaatccagaggcgacacaggagaagtctcagggaccctccaggctggaccaagtctccccccggactccaccaactgcacttcactctggac

SEQ ID NO: 789896 - DNA, 604 bp, Homo sapiens
  misc_feature: 2365.UNK.UNK.UNK.pb.heavy.1.raw 2365
ccgacacgcttgctagggacttggagctaaggacgacatattgcctttagacagtcgaaggtgacgcttagctaccactgaacgtttaggcgccagatgcggtctgggatgacctaactcgcagcttatcgatgatctactgcacgctcaaccaaccaggtcttgatgcgcgcgataggactgacggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 789897 - DNA, 713 bp, Homo sapiens
  misc_feature: 2408.44.67.G01.1.pb.heavy.1.raw 2408
ctatgcgccttgccagcccgctcagacagtatataggaagtagtccttgaccaggcaagcccagggccgctgtgcccccagaggtgctcttggaggagggtgcagggggaagaccgatgggcccttggtggaggcggagcgacggtgaccagggttccctggccccagaagtcaaacgaataataaccactccgagcgccgacttgtctcgccacagtaatagacggccgtgtcgtcgcctctcaggttgttcatttgaagataaaaccgtgtttcctggaattgtccctggagatggttgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccagctggactaagcctcctccagactccatcagccgcacctcaccactggacaccttttaaaagtccaacaaggagaacccagctcagccaaaaactccatggtgagtcctctgtgttcagtgctgatcaccgaatggaaacacctcggaatcccagttgctgggcttcctctcccccccaaacccaatatgtatactctaaatcgagcaccggtcgtgtatatactgtctgatggcgcgaagggaggcgatacg

SEQ ID NO: 789898 - DNA, 699 bp, Homo sapiens
  misc_feature: 2416.44.36.D03.1.pb.heavy.1.raw 2416
ctatgcgccttgccagcccgctcagacagtatataggaaagtagtccttgaccaggcagcccagggccgctgtgctctcggaggtgctcctggagcagggcgccaggggaagaccgatgggcccttggtggaggctgaggagacggtgaccagggttccctggccccagtggacagttcctgatataaacacaacacaataatacatgcccgtgtcctcggtttcaggttagtcattcgcagaatcaatgagttcttgaagtcatctcttgagagggtgaatctggctttcacagacgcggcgtactctgtgataaagctggcaacttgttttactgcggccaagccactccagccccttcctggagcctggcggacccagtccatatagtggtcactgatggtgaatccagaggcgacacaggagagtctcagggaccctccaggctggaccaagtctcccccggactcaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctcccccaagaagatcgtgacgcagctaaatcgagcaccggtcgtgtatatactgtctgatggcgcgaggaggcgatacg

SEQ ID NO: 789899 - DNA, 588 bp, Homo sapiens
  misc_feature: 2431.44.78.H01.1.pb.heavy.1.raw 2431
ctatgcgccttgccagcccgctcagaagtatataggaagtagtccttgaccaggcagcccagggccgctgtgctctcggaggtgctcctggagcagggcgccagggggaagaccgatgggcccttggtggaggctgaggagacggtgaccagggttcctggccccacaagtcaagccaggtgctggtggctctcgcacagaaatacacggccgtgtcctcagatctcaggctgctcagttccatgtagactgtacctgggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggcttcttcacctcagccccagactgcaccagctgtacctgggagtgggaccgtcagtcttcctcttcccccaaacccaaactactcacactaaatcgagcaccggtcgtgtatatactgtctgatggcgcgagggaggcgatacg

SEQ ID NO: 789900 - DNA, 681 bp, Homo sapiens
  misc_feature: 2442.44.45.E01.1.pb.heavy.1.raw 2442
cgtatcgcctccctcgcgccatcagacagtatattacacgaccggtgctcgatttagtgagtcagtaagggaaaggggctgggagaggagcccagcactagaagtcggcggtgtttccatttcggtgatcagcactgaacacagaggactcaccatggagtttggctgagctgggttttcctcgttgctcttttaagaggtgtccagtgtcaggttcagctggtggagtctgggggaggcgtggtccagcctgggacgtcctgagactctcctgtgtttgcgtccggactcagtttcagtgactctgccatgcacggggttccgccaggctccaggcaaggggctggagtgggtggccagtcatctggtctgatgggaagtaaagaatactatggaaactccgtgaaggccgattctccgtctcagagacaattccaagaacaccgtgtatctacaaatgaacaatttgagagccgaggactcggctctctatattgtacgagcccatcgttctacctgggccaggagccctggtcaccgtctcctcagcctccaccaagggccatcggtcttcccctggcgccctgctccaggagcacctcgagagcacagcggccctgggctgcctggtcaaggactacttcctatatactgtctgagcggggctggcaaggcgcatag

SEQ ID NO: 789901 - DNA, 701 bp, Homo sapiens
  misc_feature: 2456.44.27.C05.1.pb.heavy.1.raw 2456
ctatgcgccttgccagcccgctcagacagtatataggaagtagtccttgaccaggcagccagggcgctgtgctctcggaggtgctcctggagcaggcgcccaggggaagaccgatgggcccttgtggaggccgaggagacggtgaccaggttccctggccccagggcgtcgaatgaaccgattttggaaacagatagtctcgcacaaaaaaacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactcagcccgctcgcctggagcctggcggacccacctgcatattccaattatcgaaggtgaatccagaggctgcaccaggagagtctcagggacccccctactggggccacgcctcccccagactcacgaattgcacctgacacatgacacctcttaagagggcaacgaggaaaacccagctcagcccaaactccatggtgagtcctctgtgttcagtgatgatcaccgagtggaaacaccggcgacttccagtgctggctcgtctcccaggccccaaaccctttcgatcgcgtctaaatcgagcaccggtcgtgtatatactgtctgatggcgcgaggaggcgatacg

SEQ ID NO: 789902 - DNA, 728 bp, Homo sapiens
  misc_feature: 2465.44.86.H09.1.pb.heavy.1.raw 2465
cgtatcgcctccctcgcgccatcagacagtatatacacgaccggtgctcgatttagtgctatagacttggttggggagctctgggagaggagcccagcaccagaagtcggcggtgtttccagtcggtgatcagcacccgaacacagaggactcaccatggagtttgggctgacctggttttcctcgttgctcttttaagaggtgtccagtgtcaggtgaagctggtggagtctggggaggcgtggtccagcctgggaggtccctgagactctcctgtgtagcgtctggattcaccttcaacagacatggcatgcactgggtccgccagggctccaggcaagggactggagtgggtggcacttatatggtatgatgaagtaataaatattatgtagattccgtgaagggccgattcaccatctccagagacaattcgagaacacactatatctggaaatgaatagcctgagagccgaggacacggctgtctactactgtgcgagagatggggctcgtggatacagatatgacatgctctactccaatggtatggacgcctggggccaagggaccacggtcgccgtctctcagcctccaccaagggcccaatcggtctttccccctggcaccctcctccagagccacctctgggggcacagcggccctgggctgcctggtcaaggctacttcctatatacctgtctgagcggggctggcaaggcgcatag

SEQ ID NO: 789903 - DNA, 681 bp, Homo sapiens
  misc_feature: 2495.44.6.A06.1.pb.heavy.1.raw 2495
ctatgcgccttgccaggcccgctcagacagtatataggaagtagtccttgaccaggcagcccagggccgctgtgccccagaggtgctcctggagcagggcgccagggggaagaccgatgggcccttggtggaagctgaggtgacaaatgaccagggttccctgcccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgccccggaagtcctcgtgcgtaggtgagtggagccaaaaagagggatgattccacccatccactcaagcccttgtccaggggcctggcgcacccagttgatggtataagtagtggaactggtagtacttccagaggccgtgcaggaaagggtccaccgaggaccaggttgccggcattctgtcccagactgcaccagttgcaccagggactggacacctgtttgctgctgccaccacaaagaggaacctccaggtccagtccatggtgatgaggctgtgctcccaggggcttctttagaggaggaatgtggttgtcagtagatctaaatcgagcaccggtcgtgtatatactgtctgatggcgccgagggaggcgatacg

SEQ ID NO: 789904 - DNA, 605 bp, Homo sapiens
  misc_feature: 2518.UNK.UNK.UNK.pb.heavy.1.raw 2518
cccgacacgcttgctagggacttggagctaaggacgacatattgcctttagacagtcgaaggtgacgcgcttagctaccactgaacgtttaggccgccagatgcggtctggatgacctaactcgccagcttatcgatgatctactgcacgctcaaccaaccaggtcttgatgcgcgcgatagactgacgggatcgctacagacatttaactcgctagtaacttaatgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaccgcaaagtactagttttacgagtgggcgttgcaagccatagccagtcacaggtaataaacaattcaacgtggcgtaaagattggccgcttgctgtggcattgcaagctgggtttgcagcattgtgcatgctagacgacaatatgaatctgcgggacccctagtggccaagatggccgcagcgggttccgcagcttttgacctggaccagggtgcatagcctgcccagcct

SEQ ID NO: 789905 - DNA, 709 bp, Homo sapiens
  misc_feature: 2530.UNK.UNK.UNK.pb.heavy.1.raw 2530
ctatgcgccttgccagcccgctcagacaggtatataggggggagtagtccttgaccaggcagcccaggccgctgtgccccccagaggtgctcttggaggagggtgccagggggaagacgatgggcccttggtggaggcggagcgacggtgaccagggttccctggccccagaagtcaaacgaataataacactcgagcgccgacttgtctcgcacgagtaatagacggccgtgtcgtcgcctctcaggttgttcatttgaagataaaccgtgttcctggaattgtccctggagatggtgaatcggcccttcacggagtctgcgtagtatgtgaaatcaccagtaataaatgactgagacccactccagccccttcctggagcctggcgagacccaactcatgtagttgcctgctgacggtgagcccagaggcctgcacaggagagtctctgggacccccaggctggactaagcctcctccagactccatcagccgcacctcacactggacacggtttttaaagtccaacaaggagaacccagctcagccaaaactccatggtggagtcctctgtcgttcagtgctgatcccgaatggaaacactcggaatcccagtgctgggctcctctccccaaacccaacgtgcgagtgctaaatcgagccaccggtcgtgtatatactgtctgatggcgccgagggaggcgatacg

SEQ ID NO: 789906 - DNA, 708 bp, Homo sapiens
  misc_feature: 2538.44.36.D03.1.pb.heavy.1.raw 2538
cgtatcgcctccctcgcgccatcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtctgggggaggcttggtacagcgggggggtccctgagactctcctgtgcagcctctggattcatcttcagtgactatgccatgaactgggtccgccaggctccagggaaggggctgagtgggttttcatatgttaatattgctggagataccaccttactacgcagactctgtgaagggccgattcaccaattccagggacaatgccaagaactcactgtatctggaaatgaacagcctgagagacgaggacacggctgtctacttctgttcgagagatcgggccacttggtcagtggctggtttgactactggggccggggaaccctggtcaccgtctcctcagcctccaccaaaggcccatcggtcttcccctggcgcctgctccaggagcacctccgagagcacagcggccctgggctgcctggtcaaggactacttcctatatactgtctgagcggctggcaaggcgcatag

SEQ ID NO: 789907 - DNA, 701 bp, Homo sapiens
  misc_feature: 2540.44.55.E11.1.pb.heavy.1.raw 2540
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaacgaataataaccactccgagcgccgacttgtctcgcacagtaatagacggcgtgtcgtcgcctctcaggttgttcatttgaagataaaccgtgttcctggaattgtccctggagatggtgaatcggccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgctaatcgagcaccggtcgtgtatatactgtctgatggcgcgagggaggcgatacg

SEQ ID NO: 789908 - DNA, 692 bp, Homo sapiens
  misc_feature: 2578.44.72.G06.1.pb.heavy.1.raw 2578
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctgaccccagtagtcaatgagccacccagcgcctcccgcacaataatacacagccgtgtcctcgactctcagactgttcatttgcagatacagtgagttcttggcgttgtctctggagatggtgaatcggcccttcacagagtccacatagtgtgtctcagttccatctttcttcatgatggccacccactccagccccttccctggagcctggcggacccagttcatccaataactactaaaggtgaatccagaggctgcacaggagagtctcagggaccccccaggctggaccaagcctcccccagactccaccagttgcacctcacactggacaccttctaaaatagcaacaaggaaaacccagctcagtcccaattccatggtgagtcctctgtgctcagtgctgatcaccaagtggaaaggccttggagtccagggctaaggctcctctctccctttcccttgcagtcgtagctaaatcgagcaccggtcgtgatagtatagactgatggcgcgagggaggcgatacg

SEQ ID NO: 789909 - DNA, 647 bp, Homo sapiens
  misc_feature: 2580.44.86.H09.1.pb.heavy.1.raw 2580
cgtatcgcctcctcgcgccatcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggccaggactggtgaggccttcgggaaccctgtctctcatctgcactgtctctggagtttccatcagttctgatcattcttggggctgatccggcagcccccagggaggggaatggagtgattggtgacatccattatactggggcgacgtactactctccgtccctcaagagtcgtctcaccatttcgaggacacgtccatgaaccgcttctccctgaaactgacctccgtgaccgccgcggacacggccgtttatttctgtgcgaggcgagactggtctttcaatctatgggcccgtggcaccctggtcactgtctcctcagcttccaccaagggcccatcggtcttccccctggcgccctgctccaggagcacctctgggggcacagcggccctggctgcctggtcaaggactacttcctatatactgtctgagcggctggcaaggcgcatag

SEQ ID NO: 789910 - DNA, 720 bp, Homo sapiens
  misc_feature: 2592.44.56.F01.1.pb.heavy.1.raw 2592
cgtatcgcctccctcgcgccatcagaccagtatatacacgaccggtgctcgatttagcagacgtctgaaacacacaaaggggagctctgggagaggagccccagcgtgagattcccaggagtttccacttggtgatcagcactgagcacagaccaccaaccatggagtttgggctaatcttgattttccttgtagttttttttagaaggtgtcccagtgcgagggcggactggcggagtcgggggggggcttggcacagcccaggcggtctctgagactctcctgtgtagtctcaggattcagtcttagtgattatcacttggcctgggtccgtcaggctccagggaaggggcttgagtggatcactttcgtcagaatgaaacgttatggtggaagtaaagagtacgccgcgtctgtgaaagggaagattcaccgtctcaagggatgactccaacagtgtttggccatttacaaaagagcaatcctgagacccgacgacacaggcgtctattactgcgccaggcgatcctgggaacgtcgatgcattgatatttgggccaggggacaatggtcaccgtctcttcagcttccaccaagggcccatcggtcttccccctggcgccctgctccaggagcacctctgggggcacagcggcctgggcctgcctggtcaaggactacttcctatatactgtctgagcgggctggcaaggcgcatag

SEQ ID NO: 789911 - DNA, 679 bp, Homo sapiens
  misc_feature: 2593.44.6.A06.1.pb.heavy.1.raw 2593
cgtatcgcctccctcgcgcgcccatcagacagtatatacacgaccggtgctcgatttagatctactgacaaccacattcctcctctaaagaagcccctgggagcacagctcatcaccatggactggacctggaggttcctctttgtgtggcagcagcaacaggtgtccagtccctgggcaactggtgcagtctggactagaatgccgcaaccttggtcctcgtgaccctttcctgcacggcgctctggaagtactaccagttccactacttataccatcaactgggtgcgccaggcccctggacaagggcttgagtggatgggtggaatcatccctctttttggctcactcacctacgcacgagacttccgggcagaattacgattaccggcggacaagtccacagacacagtctccatgacaatgagttcttttgaaatccgacgacaccggccgtctactactgtgcgagaggtccgtacccagctcgcatgcatggagcctttgagatctggggcagggaaccctggtcattgtcacctcagcttccaccaagggcccatcggtcttcccctggcgccctgctccaggagcacctctgggggccacagcggccctgggctgcctggtcaaggactacttcctatatactgtctgagcgggctggcaaggcgcatag

SEQ ID NO: 789912 - DNA, 538 bp, Homo sapiens
  misc_feature: 2612.44.38.D05.1.pb.heavy.1.raw 2612
cgtatcgcctccctcgcgccatcagacagtatatacacgaccggtgctcgatttagtatctgatagttgggtttggggggtccctgagactctcctgtgcagcctctggattcaccttcagtagctactggatgcactgggtccgccaagctccaggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcggctggcaaggcg

SEQ ID NO: 789913 - DNA, 721 bp, Homo sapiens
  misc_feature: 2695.44.85.H08.1.pb.heavy.1.raw 2695
ctatgcgccttgccagcccgctcagacagtatataggaagtagtccttgaccaggcagcccagggccgctgtgcccccagaggtgctcttggaggagggtgccagggggaagaccgatgggccctggtggaggctgaggagacggtgaccgtggtcccttggccccagacgtccataccgtagtagtagtccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtattttattacttccatcataccatataagtgccacccactccagccccttgcctggagcctggcggacccagtgcatgccataggtactgaaggtgaatccagacgctgcacaggagagtctcagggacctcccaggctggaccacgcctcccccagactccacagctgcacctgacactggacacctcttaaaagagcaacgaggaaaacccagctcagcccaaactccatggtgagtcctctgtgttcagtgctgatcaccgaatggaaacaccgccgacttctagtgctgggctcctctcccagagctccccgcgactgagtgatactaaatcgagcaccggtcgtgtatatactgtctgatggcgcgagggaggcgatacg

SEQ ID NO: 789914 - DNA, 705 bp, Homo sapiens
  misc_feature: 2704.44.27.C05.1.pb.heavy.1.raw 2704
cgtatcgcctccctcgcgccatcagacagtatatacacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgagggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 789915 - DNA, 726 bp, Homo sapiens
  misc_feature: 2705.44.85.H08.1.pb.heavy.1.raw 2705
ctatgcgccttgccagcccgctcagacagtatataggaagtagtccttgaccaggcagcccagggccgctgtgccccagaggtgctcttggaggagggtgccagggggaagaccgatgggcccttggtggaggctgagggacggtgaccgtggtcctttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattactttccatcataccatataagtgccacccactccagcccccttgcctggagcctggcgacccagtgcattgccataggtactgaaggtgaaatccagaccgctgcacaggagagtctcagggacctcccaggctggaccacgcctcccccagaccatccacccgctgcacctgacactggacacctcttaagagcaacgaggaaaacccagctcagcccaaactccatggtgagtctctgtgttcagtgctgatcaccgaatgaaacacccggccgacttctagtgctgggctcctctcccagagctcccgcgactgagtgatactaaatcgagcaccggtcgtggtatatactgtctgatggcgcgagggagggcgatacg

SEQ ID NO: 789916 - DNA, 607 bp, Homo sapiens
  misc_feature: 2713.UNK.UNK.UNK.pb.heavy.1.raw 2713
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaactgtaattgagatcctaggggatgggataggaaatagaatccacccctatcacccccccacatagctgcttggggtgttgagtttacttttatttcgtgttggaatgagttgaacttccggaagtggagtaatgggtttgtctacttccctaaccgcaaaagtactagttttacgagtggcgttgcaagccatagccagtcacaggtaataaacaattcaaacgtggcgtaaagattggccgcttgctgtgggcattgcaagctggtttgcagcattgtgcatgctagacgacaatatgaatctgcggaccccctagtggccaagatggccgctagcgggttccgcagcttttgacctggaccagggtgcatagcctgcccagccttc

SEQ ID NO: 789917 - DNA, 669 bp, Homo sapiens
  misc_feature: 2739.44.12.B01.1.pb.heavy.1.raw 2739
cgtatcgcctccctcgcgccatcagacagtatatacacgaccggtgctcgatttagtagtgtagatttccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtggggagcacctactacaacccgtccctcaagagtcgagtcaccatatcagtagacacgtccaagaaccagttctccctgaagctgagctctgtgaccggccgcggacacggccgtgtattactgtgcgagagtagggcagttcgtcaccaactactttgaccactggggccagggaaccctggtcaccgtctcctcagcctccaccaagggcccatcggtcttcccctggcaccctcctccaagagcacctctgggggcacagcggccctgggctgcctggtcaaggactacttcctatatatactgtctgagcgggctggcaaggcgcatag

SEQ ID NO: 789918 - DNA, 667 bp, Homo sapiens
  misc_feature: 2768.UNK.UNK.UNK.pb.heavy.1.raw 2768
ctatgcgccttgccagcccgctcagacagtatataggaagtagtccttgaccaggcagcccagggccgctgtgccccagaggtgctcttggaggagggtgccagggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcaggagaactggttcttggacgtgtctactgatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacccatctggaagccgccaccagcaggaggaagaaccacaggtgcttcatgttcttgcacaggaggtccatgactctcagaaagccccccgcggaatctaccactactaaatcgagcaccgggtcgtgtatatactggtctgatggcgcgagggaggcgatacg

SEQ ID NO: 789919 - DNA, 618 bp, Homo sapiens
  misc_feature: 2798.UNK.UNK.UNK.pb.heavy.1.raw 2798
cgtatcgcctccctcgcgccacagacagtatatacacgaccgggtgctcgatttagacgcgatcgaagggtttgggctgagctgggttttcctcgttgccctcttaagaggtgtcatgtgtcaggtgcaattcgtggagtctgggggaggcgtggccccagtaggggggctccctgagactctcctgtgcagcctctggattcaccttcgataattggaatatgcagtgggtccgccaggctccaggcgagggctggagtgggtggcaggtgtgtcatttcatggaggaaatcaagtctacgggtgattccgttgaggccgattcaccatctccagagacaattccgagaacacagtgtctcttcaaatgaacagcctgagacctcaggacacggccgtgtattttttgtggcgagactatctgtttccaaaatcggttcattcgacgcctggggcccaggaaccctggtcaccgtctcctcggcctccacaagggccatcggtcttcccctggcgccctgctccaggagcacctccgagagcacagcggccctgggctggcctggtcaaggactacttcctatatactgtctgagcgggcgctggcaaggcgcatag

SEQ ID NO: 789920 - DNA, 664 bp, Homo sapiens
  misc_feature: 2801.44.12.B01.1.pb.heavy.1.raw 2801
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacccatctgggagccgccaccagcaggaggaagaaccacaggtgcttcatgttcttgcacaggaggtccatgactctcagaaagcccccgcggaatctacactactaatcgagcaccggtcgtgtatatactgtctgatggcgcgagggaggcgatacg

SEQ ID NO: 789921 - DNA, 694 bp, Homo sapiens
  misc_feature: 2809.UNK.UNK.UNK.pb.heavy.1.raw 2809
ctatgcgccttgccagccgctcagacagtatataggagtagtccttgaccaggcagccagggccgctgtgctctcggaggtgctcctggagcagggcgccaggggaaagaccgatgggccctggtggaggctgaggagacggtgccagggttccctggcccagtggacagttcctgatataaacacaacacaataatacatgcccgtgtcctcggttttcaggttagtcatcgcagaatcaatgagttcttgaagtcatctcttgagagggtgaatctggctttcacagaccgcgcgtactctgtgataaagctggcaactttgttttttactgcggccagccactccagccccttccctggagcctggcggacccagtccattagtggtcactgatggtgaatccagaggcgacacaggagagtctcagggacctccaggctggaccaagtctcccccggactccaccaacgcacttcactctggacacctttgtaaaataacaacaaggaaaacccagctcagcccgaactccatggtgagtcctctgtgttcagtgctgatcaccaaatgaaaacacctgggaattctgggctgggctccgctctcagagctccccaagagagatcgtgacgcagcaaaatcgagcacggtcgtgtatatactgtctgatggcgcggagggagcgataccg

SEQ ID NO: 789922 - DNA, 697 bp, Homo sapiens
  misc_feature: 2817.44.74.G08.1.pb.heavy.1.raw 2817
cgtatcgcctccctcgcgccatcagacagtattatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtgcgccaggcccctggacaagggcttgagtggatgggtggaatcatccctctttttggctcactcacctacgcacggagacttccggggcagaattacgattaccgcgcgacaagtccacagacacagtctccatgacaatgagttctttgaaatccgacgacacggccgtctactactgtgcgagagggtccgtaccccagctcgcatggagcctttgagatctggggcagggaaccctggtcattgtcacctcagcttccaccaagggcccatcggtcttcccctggcgccctgctccaggagcacctctgggggcacagcggccctgggctgcctggtcagggaactacttcctatatactgtctgagcggggctggcaaggcgcatag

SEQ ID NO: 789923 - DNA, 649 bp, Homo sapiens
  misc_feature: 2823.44.23.C01.1.pb.heavy.1.raw 2823
cgtatcgcctccctcgcgccatcagacagtatatacacgaccggtgctcgatttagtacacgtgattagggattggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatcattcttggggctggatccggcagcccccagggaggggaatggagtggattggtgacatccattatactgggcgacgtactactctccgtcctcagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttcctcctggcgccctgctccaggagcacctctggggcacagcggccctgggctgcctggtcaaggactactcctatatactgtctgagcgggctggcaaggcgcatag

SEQ ID NO: 789924 - DNA, 647 bp, Homo sapiens
  misc_feature: 2831.44.86.H09.1.pb.heavy.1.raw 2831
cgtatcgcctccctcgcgccatcagacagtatatacacgaccggtgctcgatttagtgctatagacttgggtttggggatgctttctgagagtcaaggaccttcctgtgcaagaacatgaagcacctgtggttttcctcctgctgtggcagctcccagatgggtcctgtccaggtgcagctgcagagtcgggcccaggactggtgaggccttcgggaaccctgtctctcatctgcactgtctctggagtttccatcagttctgatcattcttggctggatccggcagccccagggaggggaatggagtggattggtgacatccattatactggggcgacgtactactctccgtcctcaagagtccgttcaccatttcgaggacacgtccatgaaccgtttctccctgaaactgacctccgtgaccgccgcggacacgccgtttatttctgtgccgaggcgagactggtctttcaatctatggggccgtggcaccctgtcactgtctcctcagcttccaccaagggcccatcggtcttccccctggcgccctgctccaggagcacctctgggggcacagcggccctgggctgcctggtcaaggactactttcctatatactgtctgagcgggctggcaaggcgcatag

SEQ ID NO: 789925 - DNA, 637 bp, Homo sapiens
  misc_feature: 2869.44.38.D05.1.pb.heavy.1.raw 2869
cgtatcgcctccctcgccgccatcagacagtatatatacacgaccggtgctcgattagtatctgatagctgggttttccttgttgctattttaaaaggtgtcccagtgtgaggtgcagctggtggagtccggggggaggcttagttcagcctgggggcgggtccctgagactctcctgtgcagcctcctggattccaccttcagtagctactggatgcactggggtccgccaagctccagggaaggggctggtgtgggtctcacgtattaatagtgatgggagtagcacaagctacgcggactccgtgaagggccgatttcaccatctccagagacaacgccaagaacacgctgtatctgcaaatgaacagtctgagagcgaggacacggctgtgtattactgtgcaagagccggtgcgggagtttcggggggttgggcatactactactacggtatggacgtctggggggccaaggggaccacggtcaccgtctcctcagcttccaccaagggcccatcggtcttccccctggcgccccgcgctccaggagcacctctggggggcacagcggcctgggctgcctggtcaaggactacttcctatatactgtctgagcgggctggcaaggcgcatag

SEQ ID NO: 789926 - DNA, 581 bp, Homo sapiens
  misc_feature: 2871.UNK.UNK.UNK.pb.heavy.1.raw 2871
cgtatcgcctccctcgcgccatcagacagtatatacacgacggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactggtgcgacaggccgctggacaagggctggatggatgggatggatgaagccctatagtggcaacacggctttgcccagaagttccaaggcagagttagtatgacaggagcacctccccaggtacagtcttacatggaactgagcagcctgagatctgaggacacggccgtgtatttctgtgcgagagccaccagcacctggcttgacttgtgggccagggaaccctggtcaccgtctcctcagcctccaccaaggcccatcggtcttcccctggcgccctgctccaggagcacctccgagagcacagcggcctggctgcctgtcaaggactacttcctatatactgtctgagcgggctggcaaggcgcatag

SEQ ID NO: 789927 - DNA, 605 bp, Homo sapiens
  misc_feature: 2918.UNK.UNK.UNK.pb.heavy.1.raw 2918
gaaggctggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggtgatagggtggattctatttcctatcccatcccctaggatctcaattaagtttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 789928 - DNA, 689 bp, Homo sapiens
  misc_feature: 2920.UNK.UNK.UNK.pb.heavy.1.raw 2920
ctatgcgccttgccagcccgctcagacagtatataggaagtagtccttgaccaggcagccaggccgctgtgcttcggaggtgctcctggagcagggcgccagggggaagaccgatgggcccttggtggaggctgaggagacggtgaccagggttccctggccccagtggacagttcctgatataaacacaacacaataatacattgccgtgtcctcggttttcaggttagtcattcgcgaatcaatgagtttcttgaagtcatctcttgagagggtgaatctggctttcatagacgcggcgtactctgtgataagctggcaactttgtttttactgcggccaagccactccagccccttccctggagcctggcggaccccagtccatatagtggtcactgatggtgaatccagaggcgacacaggagagtctcaggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctgggctgggctccgctctccccaagagagatcgtgacgcagctaaatcgagcacgtcgtgtatatactgtctgatggcgcgaggaggcgatacg

SEQ ID NO: 789929 - DNA, 605 bp, Homo sapiens
  misc_feature: 2932.UNK.UNK.UNK.pb.heavy.1.raw 2932
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttccggaagttcaactcattccaacacgaaataaaagtaaactcaacaccccaagcaggctatgtgggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 789930 - DNA, 707 bp, Homo sapiens
  misc_feature: 2934.44.36.D03.1.pb.heavy.1.raw 2934
ctatgcgccttgccagcccgctcagacaggtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggtttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtggaatccagaggcgacacaggagagtctcagggaccctccaggctggaccaagtctcccccggactccaccaactgcacttcactctggacaaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 789931 - DNA, 672 bp, Homo sapiens
  misc_feature: 2956.UNK.UNK.UNK.pb.heavy.1.raw 2956
cgtatcgcctccctccgcgcctccatcagagcagatatacacgaccggtgctcgatttgagtggctacgaagggaaaggggactccctgtgccccaccatggacacactttgctccacgctcctgctgctgaccatcccttcatgggtctactgctgtcccagatcaccttgaaggagtctggtcctacgctgtgaagcccacacagaccctcaccgctgacctgcaacctctctgggttctcactcaggagtgatggagcgattgtgggctgggtccgtcagcccccaggaaaggccctggagtggcttgcactcatttattggatgatgatatggcgctacagtccatctctgaagagcagactctccatcaccggagacgcctccaatacgcaggtgatccttagagtgccaacatggcccctgcggacaagcacatactactgcgccacacatgatcaactattataaaagtggtggtatgtgaggtggctttgatatctggggccaagggaccaatggctcaccgtctcttcagcctccaccaagggcccatcggtcttccccctggcgcccctgctccaggagcacctccgagagcacagcgccctggctgcctggtcaaggatctacttcctatatactgtctgagcgggctgcaaggcgcatag

SEQ ID NO: 789932 - DNA, 701 bp, Homo sapiens
  misc_feature: 2965.UNK.UNK.UNK.pb.heavy.1.raw 2965
ctatgcgccttgccagcccgctcagacagtatataggaagtagtccttgaccaggcagcccagggcgctgtgctctcggaggtgctcctggagcagggcgccagggggaagaccgatgggcccttggtgaggctgaggagacggtgaccagggttcccggcccagtagtcaaaaccagccactgacaagtggcccgatctctcgaacagaagtagacagccgtgtcctcgtctctcaggctgttcatttccagatacagtgagttcttggcattgtccctggaattggtgaatcgcccttcacagagtctgcgtagtaggtggtatctccagcaatattaacatatgaaacccactccagccccttcctggagcctggcggacccagttcatggcatagtcactgaagatgaatccagaggctgcacaggagagtctcagggacccccccccgctgtaccaagcctccccagactccaccagccgcacctcacagtgacaccttctaaatagcaacaaggaaaaccagcgcagcccccaactccatggtgagtcctctgtgttcagtgctgatcaccaagtggaaatgccttggaatccagggctaaggcacctctctgagagctccaagagagatcgtgacgcagctaaatcgagcacggtcgtgtatatactgtctgatggcgcgagggaggcgatacg

SEQ ID NO: 789933 - DNA, 625 bp, Homo sapiens
  misc_feature: 2972.UNK.UNK.UNK.pb.heavy.1.raw 2972
gaaggctgggccaggctatgcaccctggtccagggtcaaaagctgcggaacccgctagcggccatcttggccactaggggtcccgcagattcatattgtcgtctagcatgcacaatgctgcaaaccccagcttgcaatgcccacagcaagcggccaatcttttacgccacgttgaattgtttattacctggtggactggctatggcttgcaacgccactcgtaaaaactagtactttgcggttaggggaagtaggacaaaacccattactccacttcccggaagttccaactcattccaacacgaaataaaagtaaactcaacacccccaagcaggctatgtgggggggtgataggggtggattctatttcctatcccatcccctaggatctcaattaagttactagcgagttaaatgtctgtagcggatcccgtcagtcctatcgccgcgcgcatccaaggacctggtttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcgg

SEQ ID NO: 789934 - DNA, 660 bp, Homo sapiens
  misc_feature: 2983.UNK.UNK.UNK.pb.heavy.1.raw 2983
ctatgcgccttgccagccgctcagacagtatataggaagtagtccttgaccaggcagcccagggccgctgtgcccccagagtgctcttggaggagggtgccagggggaagaccgatgggcccttggtggaggctgaggagacggtgaccagggttccctggcccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctcccactataatagatactcccatccactccagccccttccctgggggctggcggatccaggccccagtagtaactactactgctgatggagccaccagagacagtgcaggtgagggacagggtctccgaaggcttcaccagtcctgggcccgactcctgcagctgcagctgggacaggacccatctgggagccgccaccagcaggaggaagaaccacagtgcttcatgttcttgcacaggaggtccatgactctcagaaaagcccccgcggaatctacactactaaatcgagcaccgtcgtgtatatactgtctgatggcgcgaggaggcgatacg

SEQ ID NO: 789935 - DNA, 599 bp, Homo sapiens
  misc_feature: 2996.UNK.UNK.UNK.pb.heavy.1.raw 2996
cccgacacgcttgctagggactggagctaaggacgacatattgctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctagggatgggataggaaatagaatccacccctatcaccccccacatagcctgcttggggtgtgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacatatgaatctgcgggaccctagtggccaagatggcgctagcggttccgcagcttttgacctggaccagggtgcatagcctgcccagccttc

SEQ ID NO: 789936 - DNA, 687 bp, Homo sapiens
  misc_feature: 3030.44.73.G07.1.pb.heavy.1.raw 3030
ctatgcgccttgccagcccgctcagacagtatataggaagtagtccttgaccaggcagcccagggccgctgtgctctcggaggtgctcctggagcagggcgccagggggaagacgatgggcccttggtggaggctgaggagacggtgaccagggttccctggccccagtagtcaagcggggaccgtctcgagggggcctcgcacaataatagacagccgtgtcctcacttgtgaggttgtacatttgcagatgcagtgtgttcctggaattgtctctggagacggtgaatcgcccttctcggagtctccgtagtgttcttcaattccatctctgatataatggccacccactccagccccttgcctggagcctggcggacccagtgcatggcataggtcctgaagatgaatccagaggctgcacaggagagtctcagggagttcccaggctgggccgctcctcccccagactccactagctgcacctgacactggccacctcttaaaagagcaacgaggaaaacccatctcagccaaagtccatggtgagtcctctgtgttcagtgatgatcaccgaatggaaacaccggcgacttccagtgctggctcgtctccccccctgagcgtagagctaaatcgagcaccggtcgtgtatatactgtctgatggcgcgagggaggcgatacg

SEQ ID NO: 789937 - DNA, 595 bp, Homo sapiens
  misc_feature: 3031.UNK.UNK.UNK.pb.heavy.1.raw 3031
gaaggctgggcagctatgcacctggtccaggtcaaagctgcgaaccgctagcgccatctggccactaggggtccccagattcatattgtcgtctagcatgcacaatgctgcaacccagctgcaatgcccacagcaagcggccaatctttacgccacgttgaatttgtttattacctgtgactggctatggcttgcaacgccactcgtaaaactagtacttgcggttaggggaagtagacaaaccattactccacttcccggaagttcaactcattccaacacgaaataaaaggtaactcaacaccgccagcaggctagtgtggggggtgataggggtggattctatttcctatcccatccctaggatctcaattaagttactagcgagttaaatgtctgtagcgatccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 789938 - DNA, 685 bp, Homo sapiens
  misc_feature: 3032.44.45.E01.1.pb.heavy.1.raw 3032
cgtatcgcctcctcgcgccatcagacagtatatacacgaccggtgctcgatttagtgagtcagtaagggaaaggggctgggagaggagcccagcactagaagtcggcggtgttttccattcggtgatcagcactgaacacagaggactcaccatggagtttgggctgagctgggttttcctcgttgctcttttaagaggtgtccagtggtcaggtttcagctggtggagtctgggggaggcgtggtccagcctgggaccgtccctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgattctcgtctccagagacaattccaagaacaccgtgtatctacaaaatgaacaattgagagccgaggactcggctctctattattgtacgagccatcgtttctactggggccagggagccctggtcaccgtctcctcagcctccaccaagggcccatcggtcttccccctggcgccctgctccaggagcacctcccgagagcacagcggccctgggctgcctgtcaaggactacttcctatatactgtcctgagcggctggcaaggcgcatag

SEQ ID NO: 789939 - DNA, 706 bp, Homo sapiens
  misc_feature: 3044.44.36.D03.1.pb.heavy.1.raw 3044
cgtatcgcctccctcgcgccatcagacagtatatacacgaccggtgctcgatttagctgcgtcacgatctctcttggggaggctctgagagcggagccccagccccagaattcccaggtgttttcatttggtgatcagcactgaacacagaggactcaccatggagttcgggctgagctggttttccttgttgttattttacaaggtgtccagagtgaagtgcagttggtggagtccgggggagacttggtccagcctggagggtccctgagactctcctgtgtcgcctctggattcaccatcagtgaccactatatggactggggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 789940 - DNA, 600 bp, Homo sapiens
  misc_feature: 3056.UNK.UNK.UNK.pb.heavy.1.raw 3056
aggctgggcaggctatgcaccctggtccaggtcaaaagctgcggaacccgctagcggccatcttggccactaggggttcccgcagattcatattgtcgtctagcatgcacaatgctgcaaacccagcttgcaatgcccacagcaagcggccaatctttacgccacgttgaattgttattacctgtgactggctatggcttgcaacccactcgtaaaactagtactttgcggttaggggaagtagacaaacccattactccacttccggaagttcaactcattcaacacgaaataaaagtaaactcaacaccccaagcaggctatgtggggggtgataggggtggattctattcctatcccatccctaggatctcaattaagttactagcgagttaaaatgtctgtagcgatcccgtcagtcctatcgcgcgcatcaagacctggttggttgagcgtgcagtagatcatcgataagctgcgagttaggtcatcccagaccgcatctggcgcctaaacgttcagtgtagctaaggcgtcaccttcgactgtctaaaggcaatatgtcgtccttagctccaagtccctagcaagcgtgtcggg

SEQ ID NO: 789941 - DNA, 666 bp, Homo sapiens
  misc_feature: 3067.UNK.UNK.UNK.pb.heavy.1.raw 3067
cgtatcgccttccccgcgccatcagacagtatatacacgaccggtgctcgatttagtggctatagacttgggtttggggatgcttttctgagaagtcaaggacctcctgtgcaagaacatgaagcacctgtggtttttcctcctgctggtggcaagctcccagatgggtcctgtcccaggtgcagctgcaggagtcgggcccaggactggtgaggccttcgggaacgcctgtctctcatctgcaactgtctcggagttttccatcagtcttgaccattcttggggcggatccggcagccccagggaggggaatcggagtggattggtgacatccattatacctgggccgacgtactactctccgtccctcaagagtcgtctcaccatttcgagggacacgtccatgaagccgcttctcccgctgacctccgtgaccgccgcgacacggccgtttatttctgtgcgaggcgaagactggtcttttcaatctatggggccgtggcaccctggtcactggtctcctcagcttccaccaagggcccatcggtcttccccctggcgccctgctcaggagcacctctgggggcacagcggccctgggctgcctggtcaaggagtctaacttcctatatactgtctgagcgggcctggcaaggcgcatagatc

SEQ ID NO: 789942 - DNA, 701 bp, Homo sapiens
  misc_feature: 3089.UNK.UNK.UNK.pb.heavy.1.raw 3089
cgtatcgcctccctcggcgccatcagacagtatatacacgacccggtgctcgatttagctggcgtcacgatctctcttggggagctctgagagcggagcccagccccagaattccccaggtgttttcatttggtgatcagcactgaacacagaggactcaccatggagttcgggctgagctgggtttccttgttgttattttacaaggtgtccagagtgaagtgcagtggtggagtccggggagacttgtccagcctggaggggtccctgagactctcctgtgtcgcctctggattcaccatcagtgaccactatatggactgggtccgccaggctccaggaaggggctggagtggcttggccgcagtaaaacaaagttgccagctttatcacagaagtacgccgcgtctgtgaaagccagattcaccctctcaagagatgacttcaagaactcattgattctgcgaatgactacctgaaaaccgggacacggcatgtattattgtgttgtgtttatatcgaggaactgtccactgggggccagggaacctggtcaccgtctcctcagctccaccaagggcccatcgtcttccccctggcgcgcctgcccaggagcacctccggagagcacagcggccctgggctgcctggtcaaggactacttcctatatactgtcctgagcgggctggcaggcgcatag

SEQ ID NO: 789943 - DNA, 695 bp, Homo sapiens
  misc_feature: 3091.44.36.D03.1.pb.heavy.1.raw 3091
cgtatcgcctcctcgcgccatcagacagtatatacacgaccggtgctcgatttagctgcgtcacgatctctcttggggagctctgagagcggagccccagccccagaattccaggtgttttcatttggtgatcagcactgaacacagaggactcaccatggagttcgggctgagctggttttccttgttgttattttacaaggtgtcagagtgaagtgcagttggtggagtcggggagacttgtccagcctggagggtccctgagactctcctgtgtcgcctctggattcaccatcagtgaccactatatggactgggtccgccaggctccagggaaggggctggagtgctggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaaactgtccactggggccagggaaccctggtcaccgtctcctcagcctccaccaagggcccatcggtcttccccctggcgccctgctccagagcacctcgagagcacagcggccctgggctgcctggtcaaggactacttcctatatactgtctgagcgggctggcaaggcgcatag

SEQ ID NO: 789944 - DNA, 703 bp, Homo sapiens
  misc_feature: 3112.UNK.UNK.UNK.pb.heavy.1.raw 3112
cttatgacgcgccttgccagcccagaggtcagacagtatataggaagtcagtccttgaccaggcagcccagggaccgctgtgctctcggaggtgctcctggagcagggcgccaggggaagaccgatgggcccttggtggaggctgaggagacggtgaccagggctcctggccccagtagaacgatgggctcgtacaataatagagagccgagtcctcggctctcaaattgttcatttgtagatacacggtgttcttggaattgtctctggagacggagaaatcggcccttcacggagtttccatagtattctttaacttccatcagaccagatgactgccacccactccagccccttgcctggagcctggcggggcaccagtgcatggcagaggcactgaacccgagtccggacgcaacacaggagagtctccagggacttccccaggctggaccacgcctcccccagactccaccagctgaacctggacactggacacctcttaaaagagcaacgaggaaaaacccagctcagcccaaactccatggtgagtcctctgtgttcagtgctgatcaccgaatggaaacaccgccgacttctagtgctgggctcctctcccagcccctttcccttactgacttcactaaatcgagcacgcggtcgtggtattactactgtctgatggcgcgaggagggcgatacg

SEQ ID NO: 789945 - DNA, 677 bp, Homo sapiens
  misc_feature: 3117.44.12.B01.1.pb.heavy.1.raw 3117
ctatgcgccttgccagcccgctcagacagtatataggaagttagtccttgaccaggcagcccaggggccgctgtgccccagaaggtgctcttggaggagggtgccagggggaagaccgatgggccccttggtgaggctgaggagacggtgaccagggttccctggccccagtggtcaaagtagttggtgacgaaactgcccctactctcgcacagtaatacacggccgtgtccgcggcggtcacagagctcagcttcagggagaactggttcttggacgtgtctactgatatggtggacctcgactcttgagggacgggttgtagtaggtgctcccactataatagatactcccaatccactccagccccttccctggggggctggcggatccagcccagtagtaactactactgctgatggagccaccagagacagtggccaggtgagggacagggtctccgaaggcttcaccaagtcccggggcccgactccttgcagctgcagctgggacaaggacccatctgggagccgcaccagcaggaggaagaaccacaggtgcttcatgttcttggcacaggaggtccatgactctcagaaagcccccgcggaatctacactactaaatcgagcaccggtcgtgtatatactgtctgatggcgcgagggaggcgatacg

SEQ ID NO: 789946 - DNA, 681 bp, Homo sapiens
  misc_feature: 3126.UNK.UNK.UNK.pb.heavy.1.raw 3126
cgtatcgcctcctcggcgccatcagacagtatatatacacccgcggtgctcgatttagcacaccgatagttgggttgggatactttctgagactcatgggcctcctgcacaagaacatgaaacacctgtggttcttcctcctcctggtggcacctcccagatgggtcgtgtccgaggtggcagctggcaggagtcgggccccaggacgggtgaagccttcggagaccctgtccctcacctgcaatgtctctggtggttacatcagtagttattattggagttggctgcgccagtccgccggaagggactggagtggattgggcgcatctataacagtggcagcaccaactacaacccgccctcaagagtcgagtcaccatgtcactagacaggtccaagaaccagttctccctgaaattgacttctgtgaccgccgcgacacggccgtatattattgtgcgagaagattcctatcgatacagtagagacggggggggcgaactggctcgacccctggggccagggaaccctggtccaccgtctcctccagcctccaccaagggcccatcggtcttcccccggccacccctcctccaagagcacctctggggcacagcggccctggctgcctgtcaaggactacttccatatatactgtctgagcggtggcaaggcgcatag

SEQ ID NO: 789947 - DNA, 624 bp, Homo sapiens
  misc_feature: 3170.44.23.C01.1.pb.heavy.1.raw 3170
cgtatcgcctccctcgcgccatcagacagtatatacacgaccggtgctcgatttagtacacgtgattagggattgggcagggtgaacacctgtggtttttcctcctgctggtggcagctcccagatgggtcctgtcccaggtgcagctgcaggagtcgggcccagactggtgaggccttcgggaacccctgtctctcatctgcacgtgtctctggagtttccatcagttctgatcattcttggggctggatccggcagcccccagggaggggaatggagtggattggtgacatccattatactggggcgggacgtactacttctccgtccctcaagagtcgtctcaccatttcgagggacacgtcatcgaaaccgcttctccctgaaactgacctccgtgacccgccgcggacacggccgtttatttctgtgcgaggcgagactgtctttcaatctatggggccgtggcaccctggtcactgtctcctcagcttccaccaaggccatcggtcttcccctggcgcccctgctcaggagcacctctgggggcacagcggccctgggctgccttggtcaggactacttccctaatacgctgtctgagcgggctggcaaggcgcatag

SEQ ID NO: 789948 - DNA, 675 bp, Homo sapiens
  misc_feature: 3198.44.53.E09.1.pb.heavy.1.raw 3198
ctatgcgccttgccagcccgctcagacagtatataggaagtagtccttgaccaggcagcccagggccgctgtgctctcggaggtgctcctggagcagggcgccagggggaagaccgatgggccttggtggaggctgaggagacggtgaccagggttccctggcccgaatgaaaccatcccagacagtaatagacggctgtgtcctcggtgttcaggctgttcatctgcagagacaccgtatctttgaatcatctcttgagatggtgaatctgcctttcacgggtgcagcgtagtctgctgtcccaccgtcagcttggttctaatacggccaacccactccagccccttccctggagcctggcggacccaggtcatccaggcgttactgaaagtgaatccagaggctgcacaggagagtctaagggactcccaggctttaccaaacctccccagactccaccaactgcacctcacactgacaccttttaaaatagcagcaaggaaaatccagctcagcccaaactccatgtgagtcctctgtgttcagtcctgatcactgaatgaaaacacctgggaatcccaaggctgggctcctctcccagagctcaacacactctctctaaatcgagcaccggtcgtgtatatactgtctgatggcgcgagggaggcgatacg

SEQ ID NO: 789949 - DNA, 617 bp, Homo sapiens
  misc_feature: 3202.44.38.D05.1.pb.heavy.1.raw 3202
cgtatcgcctccctcgcgccatcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaagactacttcctatatactgtctgagcgggctggcaaggcgcatag

SEQ ID NO: 789950 - DNA, 703 bp, Homo sapiens
  misc_feature: 3221.44.36.D03.1.pb.heavy.1.raw 3221
cgtatcgcctccctcgcgccatcagacagtatatacacgaccggtgctcgatttagctgcgtcacgatctctcttgggggagagcggagccccagccccagaattcccaggtgttttcatttggtgatcagcaactgaacacagaggactcaccatggagttcgggctgagctgggttttccttgtttgttattttacaaggtgtccagagtgaagtgcagttggtgggagtcccggggagacttgggtccagcctggagggtcctgagactcctcctgtgtcgcctctggattcaccatcagtgaccactaatatggactgggtccgccaggctccaggaaggggctggagtggcttggccgcagtaaaaacaaagttgccagctttatcacagagtacggcgcgtctgtgaaagccagaatcaccctctcaagagatgacttcaagaactcattgattctgcgaatgactaacctgaaaaccgaggacacgggcatgtattattgtgttgtgtttaatcaggaactgtccactggggccagggaaccctggtcaccgtctcctcagcctcccaccaagggcccatcggtcttcccctggcgccctgctccaggagcaccctccgaagcacagcggccctgggctgcctggtcaaggactacttcctatatactgttctgagcgggctggcaaggcgcatag

SEQ ID NO: 789951 - DNA, 713 bp, Homo sapiens
  misc_feature: 3253.44.36.D03.1.pb.heavy.1.raw 3253
cgtatcgcctccctcgcgccatcagtctatactatcacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtctggggaggcttggtacagcgggggggtccctgagactctcctgtggcagcctctggattcatcttcagtgactatgccatgaactggggtccgccaggctccagggaaggggctggagtgggtttcatatgttaatattgctggagataccacctactacgcagactctgtgaagggccgattcaccaattccagggacaatgccaagaactcactgtatctggaaatgaacagcctgagagacgaggacacggctgtctactttctgttcgagagatcgggccacttggtcagtggctggttttgactatggggccggggaaccctgggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 789952 - DNA, 526 bp, Homo sapiens
  misc_feature: 3287.UNK.UNK.UNK.pb.heavy.1.raw 3287
gaaggctggcaggctatgcaccctggtccaggtcaaaagctgcggaaccgctagcggccatcttggccactaggggtccgcgttcatattgtcgtctagcatgcacatgctgcaacccagcttgcaatgcccacagcaagcggccatctttacggccacgtgaatgttattactgtgatgctatggcttgcaacgccactcgtatagtactttcggttaggagtagacattctccttcgaagttcaactattcaacacgaaataagtaatcaaccccaagcagtatgggggggcgatagggtggattcatttatcatcctgattcatagttcgcgataaatgtctgtagcgatcccgcgtcctatcgcgcgcatcaacctggtggtgagcgtgcagtagatcatcgatagctgcgagttagtcatcccagccgcatctggcgcctaacgttcagtggtagctaaggcgtcacttcgctgttctaaggcatagtcgtcctagctccaaggtccagcaagcgtgtcgg

SEQ ID NO: 789953 - DNA, 685 bp, Homo sapiens
  misc_feature: 3307.44.6.A06.1.pb.heavy.1.raw 3307
cgtatcgccttcctccgcgccatcagacagtatatacacgaccggtgctcgatttagatctactgacaaccacattcctcctctaaagaagcccctgggagcacagctcatcaccatggactggacctggaggttcctctttgtgtggcagcagcaacaggtgtccagtccctggtgcaactggtgcagtctggactagaatgccgcaaccttggtcctcggtgaccctttcctgcacggcctctggaagtactaccagttccactacttataccatcaactgggtgcgccaggcccctggacaagggcttgagtggatgggtggaatcatccctcttttttggctcactcacctacgcacgagacttccgggcagaattacgattaccgcggacaagtccacagaacacagtctccatgacaatgagttctttgaaaatccgacgacacggccgtctactactgtgcgagaggtccgtacgcaccagctcgcatggagcctttgagatctgggggcagggaaccctggtcattgtcacctcagccctcagcttccaccaagggcccatcggtctccccctggcgccctgctccaggagcacctctgggggcacagcggccctgggctgcctggtcaaggactacttcctatatactgtctgagcggggctggcaaggcgcatag

SEQ ID NO: 789954 - DNA, 707 bp, Homo sapiens
  misc_feature: 3309.44.55.E11.1.pb.heavy.1.raw 3309
ctatgcgccttgccagcccgctcagacagtatataggaagtagtccttgaccaggcagcccagggccgctgtgccccagaggtgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgtttccttggaattgtccctggagatggtgaatcggcccttcacggagtctgcgtagtatgtgaaatcaccagtataaatgactgagaccccactccagccccttccctggagcctggcggacccaactcatgtagttgctgctgacggtgagcccagaggctgcacaggagagtctctgggacccccaggctggactaagcctcctccagactccatcagccgcacctcacactggaacaccttttaaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgagggaggcgatacg

SEQ ID NO: 789955 - DNA, 647 bp, Homo sapiens
  misc_feature: 3372.UNK.UNK.UNK.pb.heavy.1.raw 3372
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacagtgaccagggtgccacgccccatagattgaaagaccagtctcgcctcgcacagaaataaacggccgtgtccgcggcggtcacggaggtcagtttcagggagaagcggttcatggacgtgtcctcgaaatggtgagacgactcttgagggacggagagtagtacgtcgccccagttataatggatgtcaccaatccactccattcccctccctgggggctgccggatccagccccaagaatgatcagaactgatggaaactccagagacagtgcagatgagagacagggttccgaaggcctcaccagtcctgggcccgactcctgcagctgcacctgggacaggacccatctgggagctgccaccaggcaggaggaaaaccacaggtgcttcatgttcttgcacaggaggtccttgactctcagaaagccccaatccctaatcacgtgtactaaatcgagcaccgtcgtgtatatactgtctgatggccgagggaggcgatacg

SEQ ID NO: 789956 - DNA, 702 bp, Homo sapiens
  misc_feature: 3378.44.27.C05.1.pb.heavy.1.raw 3378
ctatgcgccttgccagcccgctcagacagtatataggaagtagtccttgaccaggcagcccagggccgctgtgctctcggaggtgctcctggagcagggcgccaggggggaagaccgatgggccctttggtggaggccgaggagacggtgaccagggttcctggccccaggcgtcgaatgaaccgatttggaaacagatagtctcgcacaaaaatacacggccgtgtcctgaggtctcaggctgttcatttgaagagacactgtgtctcggaattgtctctggagatggtgaatcggcctcaacggaatcaccgtagacttgatttcctccatgaaatgacacacctgccacccactccagcccccctcgcctggagcctggcggacccactgcatattccaattatcgaaggtgaatccagaggctgcacaggagagtctcagggacccccctactggggcacgcctcccccaggactccacgaattgcacctgacacatgacacctcttaagagggcaacgaggaaacccagctcagcccaaactccatggtgagtcctctgtgttcagtgatgatcaccgagtggaacaccggcgacttccagtgctgggctcgtctcccagcccaaacccttcgatcgcgtctaaatcgagcaccggtcgtggtatatactgtctgatggcgcgagggaggcgatacg

SEQ ID NO: 789957 - DNA, 702 bp, Homo sapiens
  misc_feature: 3402.44.55.E11.1.pb.heavy.1.raw 3402
cgtatcgcctccctcgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtccagagactctcctgtgcagcctctgggctcaccgtcagcagcaactacatgagttgggtccgccaggctccagggaaggggctggagtgggtctcagtcatttatactggtgatttcacatactacgcagactccatgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctgcaccctcctccaagagcacctctggggcacagcggccctgggctgcctggtcaaggactacttcctatatactgtctgagcggctggcaaggcgcatag

SEQ ID NO: 789958 - DNA, 613 bp, Homo sapiens
  misc_feature: 3427.44.23.C01.1.pb.heavy.1.raw 3427
ctatgcgccttgccagcccgctcagacagtatataggaagtagtccttgaccaggcagccagggccgctgtgcccccagaggtgctcctggagcagggcgccaggggaagaccgatggcccttggtggaagctgaggagacagtgaccagggtgccacggccccatagattgaaagaccagtctcgcctcgcacagaaataaacggccgtgtcgcggcggtcacggaggtcagtttcagggagaagcggttcatggacgtgtcctcgaaatggtgagacgactcttgagggacggagagtagtacgtcgccccagtataatggatgtcaccaatccactccattcccctccctggggctgccggatccagccccaagaatgatcagaactgatggaaactccagagacagtgcagatgagagacagggttccgaaggcctcaccagtcctgggcccgactcctgcagctgcacctgggacaggacccatctgggagctgccaccagcaggaggaaaaaccacaggtgttcaccctgccccaatccctaatcacgtgtactaatcgagcaccggtcgtgtatatactgtctgatggcgcgagggaggcgatacg

SEQ ID NO: 789959 - DNA, 748 bp, Homo sapiens
  misc_feature: 3435.UNK.UNK.UNK.pb.heavy.1.raw 3435
ctatgcgccttgccagccccgctcagacagtatataggaagtagtccttgaccaggcagcccagggccgctgtgccccagaggtgctcttggaggagggtgccagggggaagaaccgatgggcccttggtgggaggctgaggagacggcggaccgtgggtcccttggccccaggcgtccataccattggagtagagcatgtcatatctgtatccacgagcccatctctcgcacagtagtagacagccgtgtccctcggctctcaggctattcatttccagatatagtgtgttttcttcgaattgtctctggagatggtgaatcggcccttcacggaatctacataatatttattacttccatcataccatataagtgccacccacttccagtccttgcctggagcctggcgggacccagtgcatgccatgtctgttgaagggtgaatccagacgctacacaggagagtctcagggacctcccaggctgggaccacgcctcccccagactccaacccaagctcacctgacactggacacctcttaaaagagcaacgaggaaaacccaggtcagccccaaacctccatggtgagtcctctgtgtttcggtgctgatcaccgactggaaacaccgccgacttctggtgctgggctcctctcccagagctccccaaacccaacgagcctcactctaaatcgagccacgcggtcgtgtatatactgttctgatggcgcgagggaggcgatacg

SEQ ID NO: 789960 - DNA, 711 bp, Homo sapiens
  misc_feature: 3444.44.55.E11.1.pb.heavy.1.raw 3444
cgtatcgcctccctcgcgccatcagacagtatatacacgaccggtgctcgatttagcactcgcacgttgggtttgggggggagaggagccagcactgggattccgaggtgtttccattcggtgatcagcactgaacacagaggactcaccatggagtttttggctgagctgggtttctccttgttggacttttaaaaggttgtccagtgtgaggtgcggctgatggaagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtggcgagacaagtcggcgctcggagtggttattattcgtttgacttctgggggccagggaaccctggtcaccgtcgcctccgcctccaccaagggcccatcggtcttcccctggcaccctcctccaagagcacctctgggggcacagcggccctggctgcctggtcaaggactactttcctatatactggtctgagcgggctgccaaggcgcatag

SEQ ID NO: 789961 - DNA, 718 bp, Homo sapiens
  misc_feature: 3446.UNK.UNK.UNK.pb.heavy.1.raw 3446
ctatgcgccttgcaagcccgcctcagacagtatataggaagtagtcttgaccaggcagccagggccgctgtgccgcccccagaggtgcctcctggagcaggcgccaggggaagaccgatgggcccttggtggaagctgacggtgacaatgaccaggttccctgcccccagatctcaaaggctccatgcgagagctggggggtacggaccctctcgcacagtagtagacggccgtgtcgtcggatttcaaagaactcattgtcatggagactgtgtctgtggacttgtccgcggttaaatcgtaattctgccccggaagtctcgtgcgtaggctgaggtgagccaaaaagagggcggtatgattccacccatccactcaagcccttgtcaggccttagggcctgcgcacccagttgatggtataagtagtggaactggtagttacttccagaggccgtgcaggaaagggtcaccgaggacccaaggttgcggcattctagtccagactgcaccagttgccaccagggactggacacctgttgctgctgccaccacaaagaggaacctccaggtccagtccatgtgtgatgagctgtgctcccaggggcttctttagaagaggaatgtggttgttatgtgatgctccccctgatagaggctactaaatcgaagcagccgtcgtgtatatactgtctgatggcgcgaggggaggcgatacg

SEQ ID NO: 789962 - DNA, 676 bp, Homo sapiens
  misc_feature: 3451.44.55.E11.1.pb.heavy.1.raw 3451
aagtagtccttgaccaggcagcccaggccgctgtgcccccagaggtgctcttggaggagggtgccaggggaagaccgatggccccttggtggaggcggaggcgacggtgaccaggttccctggccccagaagtcaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagagggctgcacaggagagtctctgggacgcccccaggctggactaagccctcctccagactccatcagccgcacctcaacactggacaccctttaaaagtccaacaaggagaaacccagctcagccaaaactccatggtgagtcctctgtgttcagtgctgaatcaccgaatggaaaacacctcggaatcccagtgctgggctcctctcccccccaaacccaacgtgcgagtgctaaatcgagcaccggtcgtgtatatactgtctgatggcgcgggcgagggaggcgatacg

SEQ ID NO: 789963 - DNA, 665 bp, Homo sapiens
  misc_feature: 3489.UNK.UNK.UNK.pb.heavy.1.raw 3489
cgtatcgcctcctcgcgccatcagacagtatatacacggaccggtgctcgatttagagagagtgtggtttgggttttggggggaagcacctgtggttcttcctcctgctggtggcctcccagatggtcctgtctcagccgcagctgcgggagtcgggcccaggatggtgaagccttcggagaccctgtccctccacgtgcacggtcctctggtgcctccaatcgacagaagtaatttcctaactggggctggatccgccagcccccagagaagggctgcagtggattgggagtctctattatagtgggaaacacctactacaacccgtccctcaacggtcgagtcaccatatccgtggacacgtcgaggacaccagttttccctgaaagtgagttcctgtggcccgccgcacacacggctgtcttactactgtgtcagacatgggtccgctattggcaggtcgtctcaattctactacgcttgggacgtctggggccaagggaccacggtcaccgtctcctcatcctcagcctccaccaagggcccatcggcttcccccctggcgccctgctccaggagcacctccgagagcacagcggccctgggctgcctggtcaaggactacttcctatatactgtctggagcgggctggcaaggcgcatag

SEQ ID NO: 789964 - DNA, 697 bp, Homo sapiens
  misc_feature: 3506.44.55.E11.1.pb.heavy.1.raw 3506
ctatgcgccttgcagcccgctcagacagtatataggaagtagtccttgaccaggcagcccagggccgctgtgccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggcgtgtcgtcgcctctcaggttgttcatttgaagataaaccgtgttcctggaattgtccctggagatggtgaatcggccttcacggagtctgcgtagtatgtgaaatcaccagtataaatgactgagacccactccagcccctccctggagcctggcggacccaactcatgtagttgctgctgacggtgagcccagaggctgcacaggagagtctctgggaccccccaggctggactaagcctctccagactccatcagccgcacctcacactggacaccttttaaaagtccaacaaggagaacccagctcagccaaaactccatggtgagtcctctgtgttcagtgctgatcaccgaatggaacacctcggaatccagtgctgggctcctctccccccaaacccaacgtgcgagtgctaaatcgagcaccggtcgtgtatatactgtctgatggcgcgagggaggcgatacg

SEQ ID NO: 789965 - DNA, 607 bp, Homo sapiens
  misc_feature: 3510.UNK.UNK.UNK.pb.heavy.1.raw 3510
ccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatgaatccacccctatcacccccccacatagcctgcttgggtgttgagtttactttatttcgtgttggaatgagttgaacttccgggaagtggaagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaattctgcgggacccctagtggccaagatggccgctagcgggttccgcagcttttgacctggacccagggtgcatagcctgcccagccttc

SEQ ID NO: 789966 - DNA, 744 bp, Homo sapiens
  misc_feature: 3530.UNK.UNK.UNK.pb.heavy.1.raw 3530
ctatgcgccttgccagcccgctcagacagtatataggaagtagtcccttgaccaggcagcccagggccgctgtgcccccagaggtgctcttggaggagggtgccaggggaagagccgatgggcccttggtggaggctgaggagacggcgaccgtgggtcccttggccccaggcgtccataccattggagtagagcatgtcatatctgtatccacgaggccccatctctcgcacagtagtagacagccgtgtcctcggctctccaggctattcatttccagatatagtgtgttcttcgaattgtctctggagatggtgaatcggccccttcacggaatctacataatatttattacttccatcataccatataagtgccagcacccactccagtcccttgcctggagcctggcggacccagtgcatgccatgtctgttgaaggtgaatccagacgcctacacaggagaagtctcagggaggcctcccaggctggaccacgcctcccccagactccaccagctcacctgacactggacaccctcttaaaagagcaacgaggaaaacccaggtcagccaaactccatggtggctcctctgtgttcggtgctgatcaccgactggaaacaccgcgactctggtgctgggctcctctcccagagctccccaacccaagtctatagccactaaatcgagcaccgggtcgtggatagtattagactgatggcgcgcgaggaggccgatacg

SEQ ID NO: 789967 - DNA, 600 bp, Homo sapiens
  misc_feature: 3595.UNK.UNK.UNK.pb.heavy.1.raw 3595
gaaggctgggcaggctatgcaccctggtccaggtcaaaagctgcggaacccgctagcggccatcttggccactagggtcccgcagattcatattgtcgtctagcatgcacaatgctgcaaacccagcttgcaatgcccacagcaagcggccaatctttacgccacgttgaattgtttattactgtgactggctatggcttgcaacgccactcgtaaaactagtactttgcggttaggggaagtagacaaaccattactccacttccggaagttcaactcattccaacacgaaataaaagtaaactcaacaccccaagcaggctatgtgggggggtgatagggtggattctatttcctatcccatccctaggatctcaattaagttactagcgagttaaatgtctgtagcgatcccgtccagtcctatcgcgcgcatcagacctggttggttgagcgtgcagtagatcatcgataagctgcgagttaggtcatcccagaccgcatctggcgcctaaacgttcagtgtagctaaggcgtcaccttcgactgtctaaaggcaatatgtcgtccttagctccaagtccctagcaagcgtgtcgg

SEQ ID NO: 789968 - DNA, 653 bp, Homo sapiens
  misc_feature: 3616.44.23.C01.1.pb.heavy.1.raw 3616
ctatgcgccttgccagcccgctcagacagtatataggaagtacttgaccaggccagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaaccacaggtgcttcatgttcttgcacaggaggtccttgactctcagaaagccccccaatccctaatcacgtgtactaaatcgagcaccggtcgtgtatatactgtctgatggcgcgagggaggcgatacg

SEQ ID NO: 789969 - DNA, 704 bp, Homo sapiens
  misc_feature: 3620.44.67.G01.1.pb.heavy.1.raw 3620
cgtatcgcctccctcgcgccatcagacagtatatacacgaccggtgctcgatttagagtatacatattgggtttgggggggagaggagcccagcactgggattccgaggtgtttcattcggtgatcagcactgaacacagaggactcaccatggagttttggctgagctgggttctccttgttggacttttaaaaggtgtccagtgtgaggtgcggctgatggagtctggaggaggcttagtccagcctggggggtccagagactctcctgtgcagcctctgggctcaccgtcagcagcaactacatgagttggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagttggcgctcggagtggttattattcgtttgacttctggggccagggaaccctggtcaccgtcgcctccgcctccaccaagggcccatcggtcttccccctggcaccctcctccaagagcacctcttgggggcacagcggccctgggctgcctggtcaaggactacttcctatatactgtctgagcgggctggcaaggcgcatag

SEQ ID NO: 789970 - DNA, 613 bp, Homo sapiens
  misc_feature: 3648.UNK.UNK.UNK.pb.heavy.1.raw 3648
ctatgcgccttgccagcccgctcagacagtatataggaagtagtccttgaccaggcagcccagggccgctgtgccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtcctcgaaatggtgagacgactcttgaggacggagagtagtacgtcgccccagtataatggatgtcaccaatccactccattcccctccctgggggctgccggatccagcccaagaatgatcagaactgatggaaactccagagacagtgcagatgagagacagggttcccgaaggcctcaccagtcctgggcccgactctgcagctgcacctgggacaggacccatctgggagctgccaccagcaggaggaaaaaccacaggtgttcaccctgccccaatccctaatcacgtgtactaaatcgagcacggtcgtgtatatactgtctgatggcgcgaggaggcgatacg

SEQ ID NO: 789971 - DNA, 716 bp, Homo sapiens
  misc_feature: 3651.44.62.F07.1.pb.heavy.1.raw 3651
ctatgcgccttgccagcccgctcagacagtatataggaagtagtccttgaccaggcagcccagggccgctgtgctctcggaggtgctcctggagcagggcgccagggggaagaccgatgggcccttggtggaggctgaagagacggtcaccactgtcccccggccccaagtactaaaggtgtcatggggggtcaccgttggtcctggctttcaaaacagtaatagacgcctgtgtcctcgggtctcaggttttttcattggagaacaatttgtcctgcgaattgtccctggaaaatggtgaagcggcccttcacggagtctccgtagaaagtgacaccaccagctccgatacttgagacccactccagtcccctccctggagcccggcggacccaggtcatgccataggcactaaaggtgaaatccagaggccgcacaggagaggggtcagggacctcccaggccgaatcaggccccccccagactccaacaactgcacttcacacacgacaccctttaaaaaagccacaagaaaaaggcagctcaagcccaaactccatggagacttctctctgttcggtcctggtcaccaaatgaagacacctgaaaatccagggctgggctcctctctcagagctcccctttccctttatgcgactactaaatcgagcaccggtcgtgtatatactgtctgatggcgcgagggaggcgatacg

SEQ ID NO: 789972 - DNA, 685 bp, Homo sapiens
  misc_feature: 3672.44.55.E11.1.pb.heavy.1.raw 3672
cgtatcgcctccctctgcgcccatcagacagtatatacacgaccggtgctcgatttagcactcgcacgttgggtttgggggggagaggagcccagcactgggattccgaggtgtttccattcgtgatcagcactgaacacagaggactcaccatggagttttggctgagctggttctccttgttggactttttaaaaggtgtccagtgtgaggtgcggctgatggagtctggaggaggcttagtccagcctgggggggtcccagagactctctgtcagcctctgggctcaccgtcagcagcaactacatgagttggtccgccaggctccggggggggtggtctcagtcatttatactggtgatttcacatactacgcagactccgtgagggccgattcaccatctcctagggacaattcaggaacacggttatctcaatgaacaacctgagaggcgacgacacggccgctattactgtgcgagacaagtcggcgctcggagtggttattattcgtttgattctgggccaggaaccctggtcaccgtcgcctccgcctcaccaagggcccatctctgtccccccctggcaccctcctccagagcacctctgggcacagcggccctggggctgcctggtccaaggactacttcctatatactgtctgagcggctggcaagggcatag

SEQ ID NO: 789973 - DNA, 702 bp, Homo sapiens
  misc_feature: 3681.44.36.D03.1.pb.heavy.1.raw 3681
cgtatcgcctccctcgcgccatcagacagtatatacacgaccggtgctcgatttagctgcgtcacgatctctcttgggggagctctgagagcggagccccagccccagaattcccaggtgttttcatttggtgatcagcactgaacacagaggactcaccatggagttcggctgagctgggttttccttgttgttattttacaaggtgtccagagtgaagtgcagttggtggagtccgggggagacttggtccagcctggagggtcctgagactctcctgtgtcgcctctggattcaccatcagtgaccactatatggactgggtccgccaggctccaggaagggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccaggaaccctggtcaccgtctcctcagcctccaccaagggccatcggtcttcccctggcgccctgctccaggagcacctccgagagcacagcggccctgggctgcctggtcaaggactacttcctatattactgtctgagcgggctggcaaggcgcatag

SEQ ID NO: 789974 - DNA, 551 bp, Homo sapiens
  misc_feature: 3693.44.43.D10.1.pb.heavy.1.raw 3693
ctatgcgccttgccagcccgctcagacagtatataggaagtagtccttgacaggcagcccagggccgctgtgcccccagaggtgctcctggagcagggcgccagggggaagaccgatgggcccttggtggaagctgaggagacggtgaccagggttccctggccccaggggtcgaaccacctccccgacgagctgctatactttcgggatctcgcacagtaatacacggccgtgtcctcagatctcaggctgctcagctccatgtaggctgtgtttatggaggtgttcctggtcatggtgactctgccctggaacttctgtgcatagcctgtgttaccactgttagggttcatccatccccatccactcaagcccttgtccagtggcctgtcgcacccagttgatatcataattggtgaaggtgtatccagaagccttgcaggagaccttcactgaggcccaggcttcttcacctcagccccttactgctagtctaaatcgagcaccggtcgtgtatatactgtctgatggcgcgcgagggaggcgatacg

SEQ ID NO: 789975 - DNA, 692 bp, Homo sapiens
  misc_feature: 3745.44.36.D03.1.pb.heavy.1.raw 3745
cgtatcgcctccctcgcgccatcagacagtatatacacgaccggtgctcgattagctgcgtcacgatctctcttgggagctctgagagcggagcccagcccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactggtccgccaggctccagggaaggggctggagtggcttgccgcagtaaaaacaaagttgccagctttatcacagagtacgccgcgtctgtgaaagccagattcaccctctcaagagatgacttcaagaactcattgattctgcgaatgactaacctgaaaaccgaggacacggcatgtattattgtgttgtgttattatcaggaactgtccactgggccagggaaccctggtcaccgtctcctcagcctccaccaagggccatcggtcttcccctggcgccctgctccaggagcacctcgagagcacagcggccctgggctgcctggtcaaggactacttcctatatactgtctgagcgggctggcaaggcgcata

SEQ ID NO: 789976 - DNA, 730 bp, Homo sapiens
  misc_feature: 3775.UNK.UNK.UNK.pb.heavy.1.raw 3775
cgtatcgcctccctcgcgccatcagacagtatatacacgaccggtgctcgatttagtatcacttcagttcgcggggagctctgggagaggagcccagcactagaagtcggctggtggtttccattcggtgatcagcactgaacacagagaactcaccatggagtttggctgagctgggttttcccttcgttgctcttttaagaggtgtccagtgtcaggtgcagctggtggaggtctgggggaggcgtggtccagcctgggaggtccctgagactctcctgtgcaggcgtctggattcaccttcagtacctatggcatgcactgggtccgccaggctccaggcaaggggctggagtgggtggcacttatatggtatgatggaagtaataaaatactattgcagactccgtgaagggccgattcaccatctcagagacaaattccaaggaacacgctgtatctgcaaaatgaacagcctgagagccgaggacacggctgtgtattactgtgcgaggacatattgtagtactaaccacctgctggggactacactacgggtaggacgtctccaagggaccacggtcaccgtctcctcagcctcacaagggcccatcggtcttccccctggcaccctcctccaagagcacctctggggcacagcggcctgggctggcctggtcaaggactacttttcctatatactgtctgagcgggctggcaaggcgcatag

SEQ ID NO: 789977 - DNA, 706 bp, Homo sapiens
  misc_feature: 3783.44.27.C05.1.pb.heavy.1.raw 3783
ctatgcgccttgccagcccgctcagacagtatataggaagtagtccttgaccaggcagcccagggccgcgtgctctcggaggtgctcctggagcagggcgccagggggaagaccgatgggcccttggtggaggccgaggagacggtgaccagggttccctggcccaggcgtcgaatgaaccgattttggaaacagattagtctcgcacaaaaatacacggccgtgtcctgaggtctcaggctgttcatttgaagaggacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaaggtgaatccagaggctgcacaggagagtctcagggacccccctactggggccacgcctcccccagactccacgaattgcacctgacacatgacacctctttaagagggcaacgaggaaaacccagctcagcccaaactccatggtgagtcctctgtgttcagtgatgatcaccgagtggaaacaccggcgacttccagtgctgggctcgtctcccaggccccaaaccttcgatcgcgtctaaatcgagcaccggtcgtgtatatactgtctgatggcgcgagggaggcgatacg

SEQ ID NO: 789978 - DNA, 662 bp, Homo sapiens
  misc_feature: 3799.UNK.UNK.UNK.pb.heavy.1.raw 3799
ctatgcgccttgccagcccgctcagacagtatataggaagtagtccttgaccaggcagcccagggcggctgtggccccccagaggtgctcctggagcagggcgccagggggaagaccgatgggcccttggtggaagctgaggagacagtgaccagggtgccacggcccatagattgaaagaccagtctcgcctcgcacagaaataaacggccgtgtcgcggcggtcacggaggtcagtttcagggagaagcggttcatggacgtgtccctcgaaatggtgagacgactcttgagggacggagagtagtacgtcgcccagtataatggatgtcaccaatccactccattcccctccctgggggctgccggatccagccccaagaatgatcagaactgatggaaactccagagacagtgcagatgagagacagggttcccgaaggcctcaccagtcctgggcgcccgactcctgccaggctgcacctggggacaggacccatctgggagctgccaccaggcaggaggaaaaaccacaggtggcttcatgttcttgcacaggaggtccttgactctcagaaagcatccccaaacccaagtctatagcactaaatcgaagcacgcgtcgtgtatatactgtctgatggcgcgagggaggcgatacg

SEQ ID NO: 789979 - DNA, 719 bp, Homo sapiens
  misc_feature: 3817.UNK.UNK.UNK.pb.heavy.1.raw 3817
ctatgcgccttgccagccccgctcagacagtatataggaagtagtccttgaccagcagcccagggccgctgtgcccccagaggtgctcctggagcagggcgccaggggaagaccgatgggcccttggtggaagctgaagagacggtgaccattgtcccctggccccaaatatcaaatgcatcgacgtcccaggatcgcctggcgcagtaatagacgcctgtgtcgtcgggtctccaggttggctcatttgtaaatggccaacaactgttggagtcatcccttgagacggtgaatcttcccttcacagacgcggcgtactctttacttccaccataacgtttcattctgacgaaagtgatcccacctcaagccccttccctggagcctgacggacccaggccaagtgataatcactaagaactgaatcctgagactacacaggagagtctcagagaccgccctgctgtgcaaggcccccccccgactccgccagtcgcccctcgcactggacaccttctaaaaaatacaaaggaaaatcaagattagcccaaactccatggttggtggtctgtgctcagtgctgatcaccaagtggaaactcctgggaatctcacggctggggctcctctcccagagcctccctttgtgtgttcagacgtctgtctaaatcgagcaccggtcgtgtatatactgtctgatggcgcgagggaggcgatacg

SEQ ID NO: 789980 - DNA, 695 bp, Homo sapiens
  misc_feature: 3839.UNK.UNK.UNK.pb.heavy.1.raw 3839
cgtatcgcctccctcgcgccatcagacagtatatacacgaccggtgctcgattttgatcacataacaaccacactctcctctaaagaaggccctgggagcacagctcatcaccatggactggacctggcggttcctctttgtggtggcagcagctacaggtgtccagtcccaggtgcagctggtgcagtctgggggctgaggtgaagaagcctgggtcctcggtgaaggtctcctgcaaggcttctggaggccaccttcttcagctatgcttttatttgggtgcgacaggcccctggacaagggcttgagtggctgggagggatcatccctatctttggtgcatcgaattacgcacagaagtttcaggacagagtcaccattaccgcggacgaatccacgagtacagccctacatggagctgagcaggctgagatctgaagacacggccatctatttctgtgcgagaggccctcgtcaactttcatagtccctctcatagtcccacacatggaaattggttcgacccctggggccagggaaccctggtcaccgtctcctcagcttccaccaagggcccatcggtcttcccctggcgccctgctccaggagcacctctgggggcacagcgcgcctgggctgcctggtcaaggactacttcctatatactgtctgagcgggctggcaaggcgcatag

SEQ ID NO: 789981 - DNA, 645 bp, Homo sapiens
  misc_feature: 3841.UNK.UNK.UNK.pb.heavy.1.raw 3841
ttgccagcccgctcagacagtatatatggaatagtccttgaccaggcagcccagggccgctgtgcccccagagtgctcctggagcagggcgccagggggaagaccgatgggcccttggggaagctgaggagacagtgaccagggtgccacggccccatagattgaaagaccagtctcgcctcgcacagaaataaacggccgtgtccgcggcggtcacggaggtcagtttcagggaaagcggttcatggacgtgtccctcgaaatggtgagacgacctcttttgagggacggagagtagtacgtcgcccagtataatggatgtcaccaatcactccattcccctcctgggggctgccggatccagccccaagaatgatcagaactgatggaaactccagagacagtgcagatgagagacagggttcccgaaggcctcaccagcctgggcccgactcctgcagctgcacctgggacaggacccatctgggagctgccaccagcaggaggaaaaaccacaggtgcttcatgttcttgcacagagaggtccttgactctcagaaagcatcccaaacccaagtctatatgcactaaatcggcaccggtcgtggtatatactgtctgatggcgccgaggggaggcgatacg

SEQ ID NO: 789982 - DNA, 595 bp, Homo sapiens
  misc_feature: 3842.UNK.UNK.UNK.pb.heavy.1.raw 3842
gaaggctgggcaggctatgcaccctggtccaggtcaaaagctgcggaacccgctagcggccatcttggccactagggtcccgcagattcatattgtcgtctagcatgcacaatgctgcaaacccagctgcatgccacagcagcggccatctttacgccacgttgaattgtttattacctgtgactggctatggcttgcaacgccactcgtaaaactagtactttgcggttaggggaagtagacaaacccattactccacttcccggagttcaactcattccaacacgaaataaaagtaaactcaacaccccagcaggctatgtgggggggtgataggggtggattctatttcctatcccatcccctaggatctcaattaagttactagcgagttaaattctgtagcgatccgtcagtcctatcgcgcgcatcaagacctggttggttgagcgtgcagtagatcatcgataagctgcgagttaggtcatcccagaccgcatctggcgcctaacgttcagtggtagctaaggcgtcaccttcgactgtctaaggcaatatgtcgtcctttagctcaagtccctagcagcgtgtcggg

SEQ ID NO: 789983 - DNA, 698 bp, Homo sapiens
  misc_feature: 3848.44.36.D03.1.pb.heavy.1.raw 3848
cgtatcgcctcctctcgcgccatcagacagtatatatcacgaccggtgctcgatttagctgcgtcacgatctctcttgggggagagcggagcccagccccagaattcccaggtgtttcatttggtgatcagcactgaacacagaggactcaccatggagttcggctgagctgggttttccttgttgttattttacaaggtgtccagagtgaagtgcagttggtggagtcgggggagacttggtccagcctggagggtccctgaagactctcctgtgtcgcctctggattcaccatcagtgaccactatatggactgggtccgccaggctccagggaaggggctggagtgcttgccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactgggggccagggaaccctggtcaccgtctcctcagcctccacaagggcccatcggtctttcccccctggcgccctgctccaggagcacctcgagagcacagcggccctgggctgcctggtcaaggattacttccatatatactgtctgagcgggctggcaaggcgcatag

SEQ ID NO: 789984 - DNA, 696 bp, Homo sapiens
  misc_feature: 3866.44.36.D03.1.pb.heavy.1.raw 3866
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtcagagtgaagtgcagttggtggagtcggggagacttggtcagcctggagggtccctgagactctcctgtgtcgcctctggattcaccatcagtgaccactatatggactgggtccgccaggctccagggaaggggctggagtggcttggccgcagtaaaacaaagttgccagctttatcacagagtacgccgcgtctgtgaaagccagattcaccctcaagagaatacttcaagaactcattgattctgcgaatgactaacctgaaaaccgaaggacacgggcatgtattattgtgttgtgtttatatcaggaactgtccactgggccagggaaccctggtcaccgtctcctcagcctcaccaagggcccatcggtcttccccctggcgccctgctccaggagcacctccgagagcacagcggccctgggctgcctggtcaaggactacttcctatatactgtcgagcgggctggcaaggcgcatag

SEQ ID NO: 789985 - DNA, 665 bp, Homo sapiens
  misc_feature: 3878.44.12.B01.1.pb.heavy.1.raw 3878
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtaggggcagttcgtcaccaactactttgaccactgggggccagggaaccctggtcaccgtctcctcagcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 789986 - DNA, 656 bp, Homo sapiens
  misc_feature: 3895.44.57.F02.1.pb.heavy.1.raw 3895
cgtatcgcctccctcgcgccatcagacagtatatacacgaccggtgctcgatttagctcgatatagttgggttttgggatgctttctgagagtcaaggacctcctgtgcaagaacatgaagcacctgtggttttcctcctgctggtggcagctccccagatgggtcctgtcccaggtgcagctgcaggagtcgggcccggactggtgaggccttcgggaaccctgtctctcatctgcactgtctctggagtttccatcagttctgatcattctggggctggatccggcagcccccagggaggggaatggagtgattggtgacatccattatactggggcgacgtactactctccgtccctcaagagtcgtctccaccatttcgaggggacacgtccatgaccgcttctccctgaaactgacctccgtgaccgccgcggacacggccgtttatttctgtgcgaggcgagactggtctttcaatctatggggccgtggcacccctggtcactgtctcctcagcttccaccaagggcccatcggtcttcccctggcgccctgctccaggagcacctctgggggcacagcggccctgggctgcctggtcaaggaacttacttcctatatactgtctgagcggctggcaaggcgcgcatag

SEQ ID NO: 789987 - DNA, 639 bp, Homo sapiens
  misc_feature: 3897.UNK.UNK.UNK.pb.heavy.1.raw 3897
ctatgcgccttgccagcccgctcagacagtatataggaagtagtccttgaccaggcagccaggccgctgtgccccagaggtgctctggagcagggcgccaggggaagaccgatgggcccttggtggaagctgaggagacagtgaccaggtgccacggccccatagattgaaagaccagtctcgcctcgcacagaaataaacggccgtgtccgcggcggtcacggaggtcagtttcagggagaagcggttcatggacgtgttcctcgaaatggtgagacgactcttgaggacggagagtagtacgtcgccccagtataatggatgtcaccaatcactccattccctccctgggggggctgcgatccagcccaagaatgatcagaactgatggaaactccagagacagtgcagatgagagacaggttcccgaaggcctcacagtctggccggacctgcagctgcactggacaggacccatctggggagctgcccaccagcaggaggaaaaaccacaggtgcttcatgttcttgcacaggagtccttgatctcagaaagcatcccaaacccaagtctatagcactaaatcgagcaccgggtcgtgtatatactgtctgatggcgcgcgagggaggcgatacg

SEQ ID NO: 789988 - DNA, 704 bp, Homo sapiens
  misc_feature: 3898.44.55.E11.1.pb.heavy.1.raw 3898
cgtatcgcctccctcgcgccatcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattcagggaacacggttttatcttcaaatgaacaacctgagagggcgacgacacggccgtctattactgtgcgagacaagtcggcgctcggagtggttattattcgtttgacttctggggccagggaaccctggtcaccgtcgcctccgcctccaccaaggcccatcggtcttcccctggcaccctcctccagagcacctctgggggcaccagcggccctgggctgcctggtcaaggactacttcctatatactgtctgagcgggctggcaaggcgcatag

SEQ ID NO: 789989 - DNA, 676 bp, Homo sapiens
  misc_feature: 3930.UNK.UNK.UNK.pb.heavy.1.raw 3930
cgtatcgcctccctcgcgccatcagacagtatatacacgaccgtgctcgattagtagctctatcaggggagcatcacataacaaccacattcctcctctaaagaagcccctgggagcacagctcatcaccatggactggacctggaggttcctctttgtggtggcagcagcaacagtgtccagtccctggtgcaactggtgcagtctggactagaatgccgcaacctggtcctcggtgaccctttcctgcacggcctctggaagtactacagttccactacttataccatcaactgggtgcgccaggccctggacaagggcttgagtggatgggtggaatcatccctctttttggctcactcacctacgcacgagacttccgggcagaattacgattaccgcggacaagtccacagacacagtctccatgacaatgagttcttgaaatccgacgacacggccgtctactactgtgcgagaggtccgtaccccagctcgcatggagcctttgagatctggggcagggaaccctgtcattgtcactcagcttccaccagggcccatcggtcttcccctggcgcccctgctccaggagcacctctggggcacagcgccctggctgcctgtcaaggactacttcctatatactgtctgagcgggctggcaaggcgcatag

SEQ ID NO: 789990 - DNA, 663 bp, Homo sapiens
  misc_feature: 3935.44.29.C07.1.pb.heavy.1.raw 3935
cgtatcgcctccctcgcgccatcagacagtatatacacgaccggtgctcgatttagagtgctacgaagggaaagggggactcctgtgcccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctgggttccgtcagcccccaggaaaggccctggagtggcttgcactcatttattgggatgatgataggcgctacagtccatctctgaagagcagactctccatcaccggagacgcctccatacgcaggtgatccttagagtggccaacatggcccctgcggacacagccacatactactgcgcacacatgatcaactattataaaagtggtggttatgtgagtggctttgatatctgggccaagggacaatggtcaccgtctcttcagcctccaccaagggcccatcggtcttccccctggcgccctgctccaggagcacctccgagagcacagcggccctgggctgcctggtcaaggactacttcctatatactgtctgagcgggctggcaaggcggcatag

SEQ ID NO: 789991 - DNA, 718 bp, Homo sapiens
  misc_feature: 3976.44.85.H08.1.pb.heavy.1.raw 3976
ctatgcgcccttgcagcccgctcagacagtatataggaagtagtccttgaccaggcagcccaggccgctgtgccccagagtgctcttggaggaggtgccagggggaagaccgatgggccctggtggaggctgaggagacggtgaccgtggtcccttggccccagacgtcataccgtagtagtagtcccagcaggcggtagtactacaatatgtctcgcacagtaatacacagccgtgtcctcggctctcaggctgttcatttgcagatacagcgtggttcttggaattgtctctggagatgggtgaacccgcgccttcacggagtctgcatagtatttattacttccatcatacatataagtgccacccactccagccccttgcctggagcctggcggacccagtgcatgccatagcgtactgaagggtgaatccagacgctgcacaggagagtctcaggaccctcccaggctggaccacgcctcccccagactccaccagctgcacctgacactggacacctcttaaagagcaacgagggaaaacccagctcagcccaaactccatggtgagtcctctggtgtcagtgctgatcagcgaatggaacaccgccgacttctagtgctgggctcctctcccagagctccccgcgactgagtgatactaaatcgagcaccggtcgtgtatatactgtctgaggcgcgagggaggcgatacg

SEQ ID NO: 789992 - DNA, 683 bp, Homo sapiens
  misc_feature: 3990.44.45.E01.1.pb.heavy.1.raw 3990
ctatgcgccttgccagcccgctcagacagtatataggaagtagtccttgaccaggcagcccagggccgctgtgctctcggaggtgctcctggagcagggcgccagggggaaagaccgatgggcccttggtggaggctgaggagacggtgaccagggctccctggccccagtagaacgatgggctcgtacaataatagagagccgagtcctcggctctcaaattgttcatttgtagaatacacggtgttcttggaattgtctctggagacggagaatcggcccttcacggagtttccatagtattctttacttccatcagaccagatgactgcacccactccagccccttgcctggagcctggcggacccagtgcatggcagagtcactgaactgagtccggacgcaacacaggagagtctcagggacgtcccaggctggaccacgcctcccccagactccaccagctgaacctgacactggacaccctctaaaagagcaacgaggaaaacccagctcagcccaaactccatggtgagtcctctgtgttcagtgctgatcaccgaatggaaacaccggccgacttctagtgctgggctcctctcccagcccctttcccttactgactcactaaatcgagcaccggtcgtgtatatactgtctgatggcgcgagggaggcgatac

SEQ ID NO: 789993 - DNA, 709 bp, Homo sapiens
  misc_feature: 4045.44.36.D03.1.pb.heavy.1.raw 4045
ctatgcgccttgccagcccgctcagacagtatataggaagtagtcttgaccaggcagccagggccgctgtgctctcggaggtgctcctggagcaggcgccagggggaaagacgatgggcccttggtggaggctgaggagacggtgaccagggttccccggccccagtagtcaaaaccagccactgaccaagtggcccgatctctcgaacagaagtagacagccgtgtcctcgtctctcaggctgttcatttccagatacagtgagttcttggcattgtccctggaattggtgaatcggcccttcacagagtctgcgtagtaggtggtatctccagcaatattaacatatgaaacccactccagccccttccctggagcctggcggacccagttcatggcatagtcactgaagatgaatccagaggctgcacaggagagtctcagggacccccccccgctgtaccaagcctccccagacttccaccagccgcacctcacagtggacaccttctaaaaatagcaacaaggaaaccagcgcagccccaactccatggtgagtcctctgtgttcagtgctgatcaccaagtggaaatgccttggaatccagggctaaggcacctctctgagagctcccaagagagatcgtgacgcagctaaatcgagcaccggtcgtgtatatactgtctgatggcgcgagggaggcgatacg

SEQ ID NO: 789994 - DNA, 713 bp, Homo sapiens
  misc_feature: 4046.44.56.F01.1.pb.heavy.1.raw 4046
ctatgcgccttgccagcccgctcagacagtatataggaagtagtccttgaccaggcagcccagggccgctgtgcccccagaggtgctcctggagcagggcgccagggggaagaccgatgggcccttggtggaagctgaagagacggtgaccattgtcccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagccccccccgactccgccagtcgcccctcgcactggacaccttctaaaaaaactacaaggaaaatcaagattagcccaaactccatggttggtggtctgtgctcagtgctgatcaccaagtggaaactcctgggaatctcacggctggggctcctctcccagagctcccctttgtgtgttcagacgtctgctaaatcgagcaccggtcgtgtatatactgtctgatggcgcgagggagcgatacg

SEQ ID NO: 789995 - DNA, 663 bp, Homo sapiens
  misc_feature: 4059.44.12.B01.1.pb.heavy.1.raw 4059
ctatgcgcctgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcaggagaactggttcttggacgtgtctactgatatggtgactcgactcttgaggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacccatctgggagccgccaccagcaggaggaagaaccacaggtgcttcatgttcttgcacaggaggtccatgactctcagaaagcccccgcggaatctacactactaaatcgagcaccggtcgtgtatatactgtctgatggcgccgagggaggcgatacg

SEQ ID NO: 789996 - DNA, 664 bp, Homo sapiens
  misc_feature: 4061.UNK.UNK.UNK.pb.heavy.1.raw 4061
ctatgcgccttgccagcccgctccagacagtatataggaagtagtccttgaccaggcagcccagggccgctgtgccccagaggtgctcctggagcagggcgccaggggaagaccgatgggcccttggtggaagctgaggagagacagtgaccagggtgccacggccccatagattgaaaggaccagtctcgcctcgcacagaaaataaaccggccgtgtccgcggcggtcacgcgaggtcagtttcaggagaagcgcttcatggacgtgtcccctcgaaaatggtgagacgactcttgagggacggagagtacgtcgcagccgccagtataatggatgtcaccaatcactccattccccctccctgggctgccggatccagcccaagaatgaatcagaactgatggaaactccagagacagtgcagatgagagacagggttcccgaaggccctcaccagtcctgggcccgactcctgcagctgcacctgggacaggacccatctgggagctgccaccagcaggaggaaaaaaccacagggtgcttcatgttcttgcacaggaggtccttgactctcagaaaagcatcccaaacccaactatatcgagctaaatcgagcaccggtcggtgtatatactgtctgatggcgcgagggaggcgatacg

SEQ ID NO: 789997 - DNA, 610 bp, Homo sapiens
  misc_feature: 4071.UNK.UNK.UNK.pb.heavy.1.raw 4071
ccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgatagactgacgggatcgctacagacatttaactcgctagtaacttaattgagatcctaggggatggataggaaatagaatttcacccctatcacccccccacatagcctgccttggggtgttgagtttacttttatttcgtgttggaatgagttgaacttccgggaagtgagtaatgggtttgtctactgtcccctaacgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccccctagtggccaagatggccgctagcgggttccgcagcttttgacctggaccagggtgcatagcctgcccagccttctc

SEQ ID NO: 789998 - DNA, 571 bp, Homo sapiens
  misc_feature: 4092.44.78.H01.1.pb.heavy.1.raw 4092
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggtttccctggccccacaagtcaagccaggtgctggtggctctcgcacagaaatacacggccgtgtcctcagatctcaggctgctcagttccatgtagactgtacctggggaggtgctcctggtcatactaactttctgcctggaactctggcaaagcccgtgttgccactatagggcttcatccatcccatcactccagcccttgtccagcggcctgtcgcacccagttaatatcataattgatgaacgtgtatccagaagccgtgcaggagactgtcactgaggccccaggcttcttcacctcagcagcgtggtgaccgtgacctccagcaacttcggcacccaaacccaaactactcacactaaatcgagcaccggtcgtgtatatactgtctgatggcgcgaggaggcgatacg

SEQ ID NO: 789999 - DNA, 713 bp, Homo sapiens
  misc_feature: 4098.UNK.UNK.UNK.pb.heavy.1.raw 4098
cgtaatcgcctccctcgcgccatcagaacagtatatacacgacccggtgctcgatttagtgtcgtcgcaaagagagaggagcccagccgtgagattcccaggagttttccacttggtgatcagcactgagcacagaccaccaaccatggagtttgggctatcttgattttccttgtagtttttttagaaggtgttcagtgcgaggggcgaactggcggagtcggggggggcttggcacagccagggcggtctctgagactctcctgtgtagtctcaggattcagtcttagtgattatcacttggccctgggtccgtcaggctccagggaaggggcttgagtggatcactttcgtcagaatgaaaacgttatgggtggaagtaaagagtacgccgcgtctgtgaagggaagattcccaccgtctcaaagggatgactccaaccagtgttggccatttacaaatgagcaaacctgaagacccgacggacacaggcgtctattactgcgccaggcgatcctgggaacgtcgatgcattttgatatttggggccaggggacaatggtcaccgtctctttcagcttccaccaagggcccatcggtctttcccctggcggccctgctcaggagcacctcctggggcacagcggccctgggctgcctggtcaaggaactacttcctatatactgtctgagcgggctggcaaggcgcatag

SEQ ID NO: 790000 - DNA, 701 bp, Homo sapiens
  misc_feature: 4164.44.45.E01.1.pb.heavy.1.raw 4164
ctatgcgccttgccagcccgctcagaacagattatatggaagtagtccttgaccaggcagcccagggccgctgtgctctcgaggtgctcctggagcagggcgccagggggaagaccgatgggcccttggtggaggctgaggaagacggtgaccagggctccctggccccagtagaacgatgggctcgtacaataatagagagccgagtcctcggctctcaaattgttcatttgtagatacacggtgttctttggaattgtctctggagacggagaatcgcccttcacggagttttccatagtattttttttacttccatcagacaagaatgacctgccacccactccagcccccttgcctggagcctggccggaccagtgcattggcagagttcactgaaactgagtccggacgcaacacaggagagtctcaggggacgtcccaggctggaccacgcctcccccagactccaccagctgaacctgacactggacacctctttaaaagagcaaacgaggaaaacccagctcagcccaaactccatggtggagtcctctgtgttcagtgctgatcacgaaatggaaacaccggccgacttctagtgctgggctcctctccagcccctttcccttactgactcactaaaatcgagcaccggtcgtgtatatactgtctgatggccgcgagcggaggccgatacg

SEQ ID NO: 790001 - DNA, 666 bp, Homo sapiens
  misc_feature: 4196.UNK.UNK.UNK.pb.heavy.1.raw 4196
ctatgcgccttgccagcccgctcagacagtatataggaagtagtccttgaccaggcagccagggccgctgtgcccccagaggtgctcttggaggagggtgccaggggaaggaccgatgggcccttggtggaggctgaggagacggtgaccagggttccctggccccagtggtcaaagtagttggtgacgaactgcgcctactctcgcacagtaatacacggccgtgtccgcggccggtcacagagctcagcttcagggagaactggttcttggacgtgtctactgatatggtgactcgactcttggaggacgggttgtagtaggtgctcccactataatagatactcccaatccactccagccccttccctgggggctggcggatccagccagtagtaactactactgcctgatggagccaccagagacagtgcaggtgagggacagggtctccgaaggcttcaccagtcctgggcccgactcctgcagctgcagctgggacaggacccatctgggagccgccaccagcaggaggaagaaccacaggtgcttcatgttcttgcacaggaggtccatgactctcagaaagcccccgcgcgaaatctacactactaaatcgagcaccggtcggtatatactgtctgatggcgcgagggaggcgatacg

SEQ ID NO: 790002 - DNA, 605 bp, Homo sapiens
  misc_feature: 4212.UNK.UNK.UNK.pb.heavy.1.raw 4212
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacggatcgctacagacatttaactcgctagtaacttaatgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagctttgacctggaccagggtgcatagcctgcccagccttc

SEQ ID NO: 790003 - DNA, 602 bp, Homo sapiens
  misc_feature: 4213.UNK.UNK.UNK.pb.heavy.1.raw 4213
gaaggctgggcaggctatgcaccctggtccaggtcaaaagcctgcggaacccgctagcggccatcttggccactagggtcccgcagattcatattgtcgtctagcatgcacaatgctgcaaacccagcttgcaatgcccacagcaagcggcaatctttacgccacgttgaattgtttattacctgtgactggctatgcttgcaacgccactcgtaaaactagtactttgcggttaggggaagtagacaaacccattactccacttcccgaagttcaactcattccaacacgaaataaaagtaaactcaacaccccaagcaggctatgtggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagacgcatctggcgcctaaacgttcagtggtagctaaggcgtcaccttcgactgtctaaaggcaatatgtcgtccttagctcaagtccctagcaagcgtgtcggg

SEQ ID NO: 790004 - DNA, 677 bp, Homo sapiens
  misc_feature: 4223.44.36.D03.1.pb.heavy.1.raw 4223
ctatgcgccttgccagcccgctcagacagtatataggaagtagtccttgaccaggcagcccaggccgctgtgctctcggaggtgctcctggagcagggcgcagggggaagaccgatgggcccttgtggaggctgaggagacggtgaccagggttcctggccccagtggacagttcctgatataaacacaacacaataatacatgcccgtgtctcggtttcaggtagtcattcgcagaatcaagagttcttgaagtcatctctgagagggtaatctggcttcacagacgcggcgtactctgtgataaagctggcactttgtttactgcggccaagcactccagccccttcctggcctggcggacccagtccatatagtggcactgatggtgatcagaggcgcacaggagagtctcagggaccctccaggctgacaagtctcccccgactccaccaactgcacttcactctggacaccttgtaaaataacaacaaggaaaacccagctcagcccgaactccatggtgagtcctctgtgttcagtgctgatcaccaatgaaaacacctggaattctggggctgggctccgctctcagagctccccaagagagatcgtgacgcagctaaatcgagcaccggtcgtgtatatactgtctgatggcgcgagggaggcgatacg

SEQ ID NO: 790005 - DNA, 742 bp, Homo sapiens
  misc_feature: 4235.44.36.D03.1.pb.heavy.1.raw 4235
cgtatcgcctccctcgcgccatcagacagtatatacacgaaccggtcctcgcgccatcagacagtatatacacgaccggtgctcgatttagctgcgtcacgatctctccttggggagctctgagagcggagcccagcccccagaattcccaggtgttttcatttggtgatcagcactgaacacagaggactcaccatggagttcgggctgagctgggttttccttgttgttattttacaaggtgtccagagtgaagtgcagttggtggagtccggggggagacttggtccagcctggagggtccctgagactctcctgtgtcgctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaacctggtcaccgtctcctcagcctccaccaagggcccatcggtcttccccctggcgccctgctccaggagcacctccgagagcacagcggccctgggctgcctggtcaaggactacttcccttatatactgtctgagcgggctggcaaggcgcatag

SEQ ID NO: 790006 - DNA, 629 bp, Homo sapiens
  misc_feature: 4270.UNK.UNK.UNK.pb.heavy.1.raw 4270
cgtatcgcctccctcgcggccatcagacagtatatacgacgaccggtgctcgatttagtatcactcagtcgcggggagctctgggagagagcccagcactagagtcgcggttttccattcggtgatcagcactgaacacagaggactcaccatggagtttgggctgagctgggttttcctcgttgctcttttaagaggtgtccagtgtcaggtgcagctggggagtctgggggaggcgtggtccagcctgggaggtccctgagactctcctgtgcagcggtctggattcacctttcagtacctatgcatgcactgggtccgccaggctccaggcaaggggctggagtgggtggcacttatatggtatgatggaagtaataaaatactatgcagactccgtgaaggggcgattccaccattccagagacattccaagaacacgctgtatctgcaaatgaacagcctgagagccgaggacacggctgtgtattactgtgcggaggacatattgtagtactaccacctgctgggactactactacgtatggacgtctggggccaagggacccacggtcaccgtctcctcagcctccaccaaggcccatcggtcttccccctggcaccctcct

SEQ ID NO: 790007 - DNA, 694 bp, Homo sapiens
  misc_feature: 4271.UNK.UNK.UNK.pb.heavy.1.raw 4271
cgtatcgcctccctcgcgccatcagacagtatatacacgaccgggtgctcgatttagcactcgcacgttgggtttttggggagaggagcccagcactgggattccgaggtgtttccattcggtgatcagcactgaacacagaggactcaccatggagttttggctgagctgggtttctccttgttggacttttaaaaggtgtccagtggtgaggtgcgctgatggagtctggaggaggcttagtccagcctggggtccagagactctcctgtgcagcctctgggctcaccgtcagcagcaactacatgagttgggtcgcaggctccagggaagggctggagtggggtctcagtcatttatactggtgatttcacattactacgcagactccgtgaagggcgattcaccatctcagggacattccaggaacacggtttatcttcaaatgaacaacctgagaggcgacgacacggccgtcattactgtgcgagacaagtcgcgctcggagtggttattattcgtttgacttctggggccagggaaccctggtcaccgtcgctccgcctccaccaagggcccatcgtcttcccctggcaccctctccaagagcacctctgggggcacagcggccctgggctgcctggtcaaggactacttcctatatactgtctgagcgagctggcaaggcgcatag

SEQ ID NO: 790008 - DNA, 718 bp, Homo sapiens
  misc_feature: 4274.44.36.D03.1.pb.heavy.1.raw 4274
cgtatcgcctccctcgcgccatcagacagtatatacacgaccggtgctcgatttagctgcgtcacgatctctctcttggggagctctgaagagcggagccccagccccagaattcccaggtgttttcatttggtgatcagccactgaacacagaggactcaccatggagttcgggctgagctgggtttttccttgttgttattttacaaggtgtccagagtgaagtgcagttggtggagtccgggggagacttggtccagcctggagggtccctgagactctcctgtgtcgcctctggattcaccatcagtgaccactatatggaactgggtccgccaggctccagggaaaggggcctggagtggcttggccgcagtaaaaacaaagttgccagctttatcacagagtacggccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcaggcctccaccaaggggcccatcggtcttcccccctggcgccctgctccaggagcacctccgagagcacagcggccctgggctgcctggtcaaggactacttcctatatactgtctgagcgggctggcaaggcgccatag

SEQ ID NO: 790009 - DNA, 665 bp, Homo sapiens
  misc_feature: 4291.UNK.UNK.UNK.pb.heavy.1.raw 4291
ctatgcgccttgcagcccgctcagacagtatataggaagtagtccttgaccaggcagcccagggccgctgtgctctcgaggtgctcctggagcagggcgccaggggggaagaccgatggcccttggtggaggctgaggagacggtgaccagggctccctggcccagtaaacgatggctcgtacaataatagagagccgagtcctcgctctcaaatgttcatttgtagatacacggtgttctgaattgtctctggagacggagaatcggcccttcacggagtttccatagtattctttacttccattcagaccagatgactgccaccactccagccccttgctggagcctggcgacccagtgcatggcagagtcactgaaactgagtccggacgcaacacaggagagtctcaggggacgtcccaggctggaccacgcctccccagactccacagctgaacctgacactggacaccttcttaaaagagcaacgaggaaacccagctcagcccaaactccatggtgagtcctctgtgttcagtgctgatcaccgatggaaacaccgccgacttctagtgctggctcctctcccagccctttcccttactgactcactaaatcgagcaccgtcgtgtatactgtctgatggccgcgaggaggcgatacg

SEQ ID NO: 790010 - DNA, 607 bp, Homo sapiens
  misc_feature: 4302.UNK.UNK.UNK.pb.heavy.1.raw 4302
ccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcaccccccacatagcctgcttggggtgttgagtttacttttatttcgtgttggaatgagttgaacttccgggaagtggagtaatgggttttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 790011 - DNA, 674 bp, Homo sapiens
  misc_feature: 4338.UNK.UNK.UNK.pb.heavy.1.raw 4338
cgtatcgcctccctcgcgccatcagaaagtatataccggacggtgctcgtttagtagctctatcagggggagcatcacatacaccacattcaacctctagaaaagccctggagcaccagctcatcaccatgactggacctggaggttcctctttgtgtggcagcagcaacaggtgtccagtccctggtgcactgggcagttggactagaatgcgcaaccttgtcctcggtgaccctttcctgcacggctctgaagtactaccagttccactactataccatcaactgggtgcgcaggcccctggacaagggcttggtggatgggtggaatcatcccctttttttggctcactcacctacgcacgagacttccgggcagaattacgattaccgcggacaagtccacagacacagtctcatgacaatgagttctttgaatccgacgacacggccgtctactactgtgcgagaggtccgtaccccagctcgcatggagcctttgagatctgggggcagggaaccctggtcattgtcacctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 790012 - DNA, 639 bp, Homo sapiens
  misc_feature: 4352.44.23.C01.1.pb.heavy.1.raw 4352
cgtatcgcctccctcgcgccatcagacagtatatacacgaccggtgctcgatttagtacacgtgattagggattgggggctttctgagagtcaaggacctcctgtgcaagaacatgaagcacctgtggtttttctcctgctggtggcagctcccagatgggtctgtccaggtgcagctgcaggagtcgggcccaggactggtgatggcttcgggaaccctgtctctcatctgcactgtctctggagtttccatcagttctgatcatcttggggctggatccggcagcccccagggagggaatggagtgattggtgacatccattatactgggcgacgtactactctccgtcctcaagagtcgtctcaccatttcgagggacacgtccatgaaccgcttctcctgaaactgacctccgtgaccgccgcggacacggccgtttatttctgtgcgaggcgagactggtctttcaatctatgggccgtggcaccctggtcctgtctcccagcttccaccaagggcccatcggtcttcccctggcgccctgctcaggagcaccctctggggccagcggccctgggctgccttggtcaaggactacttcctatatactgtctgagcgggctggcaaggcgcatag

SEQ ID NO: 790013 - DNA, 729 bp, Homo sapiens
  misc_feature: 4372.44.86.H09.1.pb.heavy.1.raw 4372
ctattgcgccttgccagcccgctcagacagtatataggaagtagtccttgaccaggcagcccagggccgctgtgcccccagaggttgctcttgggaggagggtgccaggggaagaccgatgggcccttggtggaggctgaggagacggcgaccgtggtcccttgcccaggcgtccataccattggagtagagcatgtcatatctgtatccacgagccccatctctcgcacagtagtagacagccgtgtcctcggctctcaggctattcatttccagatatagtgtgttcttcgaatttgtctctggagatggtgaatcggcccttcacggaatctacataatatttattacttccatcataccatataagtgccacccactccagtcccttgcctggagcctggcggaccagtgcatgccatgtctgttgaaggtgaatccagacgctacacaggagagtctcagggacctcccaggctggaccacgcctcccccagactccaccagcttcacctgacactggacacctcttaaaaagagcaacgaggaaaacccaggtcagcccaaactccatggtgagtcctctgtgttcggtgctgatcaccgactggaaacaccgccgacttctggtgctgggctcctctcccagagctccccaacccaagtctatagcactaaatcgagcaccggtcgtgtatatactgtcgatggcgcgagggaggcgatacg

SEQ ID NO: 790014 - DNA, 708 bp, Homo sapiens
  misc_feature: 4378.44.55.E11.1.pb.heavy.1.raw 4378
ctatgcgccttgccagcccgctcagacagtatataggaagtagtccttgaccaggcagcccagggccgctgtgcccccagaggtgctcttggaggaggcgtgccagggggaagaccgatggccccttggtggaggcggaggcgaccggtgaccagggttccctggccccagaagtcaaacgaataataaccactccgagcggccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactcagccccttccctggagcctggcggacccaactcatgtagttgctgctgacggtgagcccagaggctgcacaggagagtctctgggccccccaggctggactaagcctcctccagaactccatcagccgcacctcacactggacaccttttaaaagtccaacaagagaacccagctcagccaaaaactccatggtgagtcctctgtgttcagtgctgatcaccgaatggaaacacctcggaatcccagtgctgggcctcctccctcccccaaacccaacgtgcgagtgctaaatcgagcaccggtcgtgtatatactgtctgatgggcgccgagggaggcgat

SEQ ID NO: 790015 - DNA, 585 bp, Homo sapiens
  misc_feature: 4388.UNK.UNK.UNK.pb.heavy.1.raw 4388
cgtatcgccttccctcgcgccatcagacagtatatacacgaccggtgctcggattttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaaactggggtgcgacaggccgctggacaaggggctggaagtggatgggatggatgaaggcctatagtggcaacacgggctttgcccagaagttccaaggcagagttagtatgaccaggagcacctccccaggtacagtctacatggaactgagcagcctgagattctgaggacacggccgtgtattttctgtgcgagagccaccgcacctggcttgacttgtggggccagggaaccctgggtcaccgtctcctcagcctccaccaagggccatcgggtcttccccctggcgccctgctccaggagcacctccgagagcacagggcgccctgggctgcctggttcaaggactacttcctatattactgtctgagcgggctggcaaggcgcatag

SEQ ID NO: 790016 - DNA, 717 bp, Homo sapiens
  misc_feature: 4406.UNK.UNK.UNK.pb.heavy.1.raw 4406
cgtatcgcctccctcgcgccatcagtctatactatcacgaaccgggtgctcgatttagctgcgtcacgattctctcttgggagctctgagagcggagcccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtggaccactatatggactggggtccgccaggctccaggggaaggggctggagtggcttggccgcaagtaaaaacaaagttgccagctttatcacagagtacgccgcgtctgtgaaagccagattcaccctctcaagagatgacttcaagaactcattgattctgcgaatgactaacctgaaaaccgaggacacggggcatgtattattgtgttgttgttttatatcaggaactgtccactggggcccagggaaccctggtcaccgtctccttcagcctccaccaagggcccatcggtcttccccctggcgccctgctccaggagcacctccgagagcacagcggccctgggctgcctggtcaaggactacttccctatatacctgtctgagcgggctggcaaggcgcatag

SEQ ID NO: 790017 - DNA, 695 bp, Homo sapiens
  misc_feature: 4409.UNK.UNK.UNK.pb.heavy.1.raw 4409
ctatgcgccttgccagccgctcagacagtatataggaagtagtccttgaccaggcagccagggcgctgtgctctcggaggtgctcctggagcagggcgccagggggaagaccgatgggcccttggtggaggctgaggaggacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcgcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctccccagactccaccaactgcacttcactctggacaccttgtaaaataacaacaaggaaaacccagctcagcccgaactccatggtgagtcctctgtgttcagtgctgatcaccaaatgaaaacactgggaattctggggcttggggctccgctctccccaagagagatcgtggacgcagctaaatcgagcaccggtcgtgtatatactgtctgatggcgcgagggaggcgatacg

SEQ ID NO: 790018 - DNA, 572 bp, Homo sapiens
  misc_feature: 4413.44.37.D04.1.pb.heavy.1.raw 4413
ctatgcgccttgccagcccgcctcagacagtatataggaagtagtccttgaccaggcagcccagggccgctgtgcccccagaggtgctcctggagcagggcgccagggggaagaccgatgggcccttggtggaagctgaggagacggtgaccgacgtcccctgccccagacatccatcaaatagtagtagtttatgattccccgaaccgtttccttggaggtcgcccctcgcacagtaataacagacgtgtcgtcaactctcacgctgttcatttgcaaatacagcatattcttggaattgtctctggagatggtgaatcggcccttcacggagtctgagtaatacttctcacttccatcgtcggagatgactgccacccactccggccccttgcctggagcctggcggacccagtgcaaaccaaatctatcgaatgagaacccagagggctacacaggagagtctcagggacctcccgggctggaccacgcctccccaaacccaacagtatgctactaaatcgagcaccggtcgtgtatatactgtctgatggcgcgagggaggcgatacg

SEQ ID NO: 790019 - DNA, 593 bp, Homo sapiens
  misc_feature: 4434.UNK.UNK.UNK.pb.heavy.1.raw 4434
gaaggctggcaggctatgcaccctggtccaggtcaaaagctgcggaacccgctagcgcatctggccactagggggtcccgcagattcatattgtcgtctagcatgcacaatgctgcaaaccagcttgcaatgccacagcaagcggccaatctttacgcacgttgaattgtttattacctgtgactgctatggcttgcaacgcactcgtaaaactagtactttgcggttaggggaagtagacaaacccattactccacttccgaagttaactcattccaacacgaaataaaagtaaactcaaccaccccaagcggctatgtgggggggtgataggggtggattctatttcctatcccatcccctaggatctcaattaagttactagcgagttaaatgtctgtagcgatcccgtcagtcctatcgcgcgcatcaagacctggttggtgagcgtgcagtagatcatcgataagctgcgagttaggtcatcccagaccgcatctggcgcctaaacgttcagggtagctaaggcgtcaccttcgactgtctaaaggcaatatgtcgtcttagctccaagtccctagcaagcgtgtcgg

SEQ ID NO: 790020 - DNA, 609 bp, Homo sapiens
  misc_feature: 4460.UNK.UNK.UNK.pb.heavy.1.raw 4460
gaaggctggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgaactggctatggcttgcaaacgccactcgtaaaactagtactttgcggttaggggaagtagacaaacccattactcacttcccggaagttcaactcattccaacacgaaataaaagtaaactcaacaccccaaggcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 790021 - DNA, 681 bp, Homo sapiens
  misc_feature: 4466.44.67.G01.1.pb.heavy.1.raw 4466
ctatgcgccttgccagccgctcagcagtatataggaagtagtccttgaccaggcagcccagggccgctggtgccccccagagtgtcttggaggagggtgccaggggaagaccgatgggcccttggtgaggcggaggcgacgggtgaccaggtcctggcccagaatcaaacgaataataaccactccgagcgccgacttgtctcgcacagtatagaggccgtgtcgtcgccttcaggttgttcatttgaagataaaccgtgttcctggaattgtcctggagatggtgaacggccttcacgggtctgcgtagtatgtgaaatcaccagtataatgactgagaccacccagcctcctgagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaaacccagctcaggcaaaactccatggtgagtcctctgtgttcagtgctgatcaccgaatggaaacacctcggaatccagtgctggctcctctccccccaaaacccaatatgtatactctaaatcgagcaccggtcgtgtatatactgtctgatgcgcgagggaggcgatacg

SEQ ID NO: 790022 - DNA, 606 bp, Homo sapiens
  misc_feature: 4468.UNK.UNK.UNK.pb.heavy.1.raw 4468
cccgacacgcttgctagggacttggagctaaggacgacatattgctttagacagtcgaaggtgacgccttagctaccactgaacggtttagcgccagatgcggtctgggatgacctaactcgcaggcttatcgatgatctactgcacgctcaaccaaccaggtcttgatgcgcgcgataggactgacgggatcgctacagacatttaacttcgctagtaacttaattgagatcctagggatgggataggaaatagaatccacccctatcaccccccacatagcctgcttggggtgttgagtttacttttatttcgtgttgaatgagttgaacttccggaagtggagtaatgggtttgtctacttcccctaaccgccaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 790023 - DNA, 654 bp, Homo sapiens
  misc_feature: 4542.44.23.C01.1.pb.heavy.1.raw 4542
ctatgcgccttgccagcccgctcagacagtatattaggaagtagtccttgaccaggcagccagggccgctgtgcccccagaggtgctcctggagcagggcgcccagggggaagaccgatgggcccttggtggaaagctgaggagacagtgaccagggtgccacggccccatagattgaaaagaccagtctcgcctccgcacagaaataaacggccgtgtccgcggcggtcacggagtcagtttcagggagaagcggtcatggacgtgtccctcgaaatggtgagacgactcttgagggacggagagtagtacgtcgccccagtataatggatgtcaccaatccactccattcccctcccctggggctgccgatccagccccagaatgatcagaactgatggaaactccagagacagtgcaggatgagagacaggtcccgaaggcctcaccagtctggcccgactcctgcagctgcacctgggacaggacccatctgggagctgccaccagcaggaggaaaaaccacaggtggcttcatgttcttgcacaggaggtccttgactctccagaaaagcccccaatccctaatcacgtgtactaaatcgagcaccggtcgtgtaatatactgtctgatggcgcgagggaggcgatacg

SEQ ID NO: 790024 - DNA, 619 bp, Homo sapiens
  misc_feature: 4649.UNK.UNK.UNK.pb.heavy.1.raw 4649
ctatgcgccttgccagcccgctcagacagtatataggaagtagtccttgaccaggcagcccagggccgctgtgccccccagaggtgctcctggagcagggcgccagggggaagaccgatgggcccttggtggaagctgaggagacggtgaccgtggtcccttggccccagacgtccataccgtagtagtagtatgcaactccccgaactccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttcctggagctggcggacccagtgcatccagtagctactgaaggtgaatccagaggctgcacaggagagtctcagggacccccccaggctgaactaagcctccccggactccaccagctgcacctcacactggacaccttttaaaatagcaacaaggaaaacccagctatcagatactaaatcgagcaccgggtcgtgtatatactgtctgatgggcgcgagggaggcgatacg

SEQ ID NO: 790025 - DNA, 674 bp, Homo sapiens
  misc_feature: 4671.44.56.F01.1.pb.heavy.1.raw 4671
cgtatcgcctccctcgcgccatcagacaatatacacgaccggtgctcgattagcagacgtctgaacacacaaaggggctggagagagcccagccgtgagattccaggagtttccactggtgatcagcactgagcacagaccaccaaccatggagtttgggctaatcttgattttccttgtagttttttagaaggtgtccagtgcgagggcgactggcggagtcggggggcttggcacagcagggcgtctctgagactctcctgtgtagtctcaggattcagtcttagtgattatcacttgcctgggtccgtcaggctccagggaaggggcttgagtggatcactttcgtcagaatgaaacgttatggtggagtaaagagtacgccgcgtctgtgaagggagattcaccgtctcaagggatgactccaacagtgttggccatttacaaatgagcaacctgagacccgacgacacaggcgtctattactgcgccaggcgatcctgggacgtcgatgcatttgatatttggggccagggacaatggtcaccgtctattcagcttccaccaagggccatcggtcttcccctggcgcctgctccaggagcacctctgggggcacagcggcctgggctgcctggtcaaggactacttcctatatactgtctgagcggctg

SEQ ID NO: 790026 - DNA, 652 bp, Homo sapiens
  misc_feature: 4712.44.70.G04.1.pb.heavy.1.raw 4712
cgtatcgcctcctcggcgccatcagacagtatatacacgaccggtgctcgatttagtgtagtgtgaagggaaagggggactccctgtgccccaccatggacacactttgctccacgctcctgctgctgaccatcccttcatggggcctgtcccagatcaccgtggaaaggagtctggccctacattggtgaaacccacacagaccctcacgctgacctgcaccgtctcaggcttctcactcgtcactcctggagagggcgttgtctggtgcggcagccgccggaaaggccctggagtggatcgcactcacttattggaatgacgatatacgatatagtccttctctgacgaccagactcacgctcacgaaggacacgtccaaaaccaggtggtccttacattgaccaacgtggaccctgtggacacaggccacatatttctgtgcccacttcatgaccacaatgaccacgggcttcttcgaacccctggggccagggaatccaggtcaccgtctcatcagcctccaccaagggcccatcggtcttcccctggcgcctgctccaggagcacctccgagagcacagcggccctgggctgcctggtcaaggactacttcctatatactgtctgagcgggctggcaaggcgcatag

SEQ ID NO: 790027 - DNA, 701 bp, Homo sapiens
  misc_feature: 4739.44.36.D03.1.pb.heavy.1.raw 4739
ctatgcgccttgccagcccgctcagacagtatataggaagtagtccttgaccaggcagccaggccgctgtgctctcggaggtgctcctggagcagggcgccaggggaagaccgatgggcccttggtgaggctgaggagacggtgaccagggttccctggccccagtggacagtttcctgatataaacacaacacaataatacatgcccgtgtcctcggttttcaggttagtcattcgcagaatcaatgagttcttgaagtcatctcttgagagggtgaatctggctttcacagacgcggcgtactctgtgataagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctcccccaagagagatcgtgacgcagctaaatcgagcaccggtcgtgtatatacctgtctgatggcgcgaggagcgatacg

SEQ ID NO: 790028 - DNA, 725 bp, Homo sapiens
  misc_feature: 4778.44.86.H09.1.pb.heavy.1.raw 4778
ctatgcgccttgccagcccgctcagacagtatataggaagtagtccttgaccaggcagcccagggccgctgtgcccccagaggtgctcttggaggagggtgccagggggaagaccgatgggcccttggtggagctgaggagacggcgaccgtggtcccttggccccagcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggaccagtgccatgccatgtctgttgaaggtgaatccagacgctacacaggagagtctcagggacctcccaggctggaccacgcctccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctccagagctccccaacccaagtctatagcactaatcgagcaccggtcgtgtatatactgtctgatggcggcgagggaggcgatacg

SEQ ID NO: 790029 - DNA, 602 bp, Homo sapiens
  misc_feature: 4779.UNK.UNK.UNK.pb.heavy.1.raw 4779
ctatgcgccttgccagcccgctcagacagtatataggaagtagtccttgaccaggcaggcccagggccgctgtgctctcggaggtgctcctggaggcagggcgccagggggaagaccgatgggcccttggtggaggctgaggagacggtgaccagggttccctggccccaccaagtccaagccaggtgctggtggctctcgcacaagaaatacacgggccgtgtcctcagatctcaggctgctcagttccatgtagactgtacctgggggaggtgctcctggtcatactaaactctgccttggaaactctgggcaaagcccgtgttgccactataggccttcatccatcccatccactccagcccttgtccagcggcctgtcgcacccagttaatatcataattgatgaacgtgtatccagaagccgtgcaggagactgtcactgaggcccccccaggcttcttcacctcagccccagactgcaccagctgtacctgggagtggaccgtcagtcttcctcttccccccaaacccaaactactcacactaaatcgagcacaggtcgtgtatatactgtctgatggcgcgagggaggcgatacg

SEQ ID NO: 790030 - DNA, 724 bp, Homo sapiens
  misc_feature: 4804.UNK.UNK.UNK.pb.heavy.1.raw 4804
ctatgcgccttgccagccccgctcagacagtatatataggaagtagtccttgaccaggcagcccagggccgctgtgcccccagaggtgctcctggagcagggcgccagggggaagaccgatgggccttggtggaagctgaagagacggtgaccattgtcccctggccccaaatatcaaatgcatcgacgtcccaggatcgcctggcgcagtaatagacgcctgtgtcgtcggggtctcaggttgctcatttgtaaatggccaacactgtttggagtcatcccttgagacggtgaatcttcccttcacagacgcggcgtactctttacttccaccataacgtttcattctgacgaaagtgatccactcaagccccttccctggagctctgacggacccaggccaagtgataatcactaagactgaatcctgagactacacaggagagtctcagagaccgccctggctgtgccaagccccccccccgactccgccagttcgcccctcgcactggacaccttctaaaaaaactacaagaaaatcaagattagcccaaactccatggtttggtggtctgtgctcagtgctgatcaccaagtggaaactcctgggaatctcacggctggggctcctctcccagagctcccctttgtgtgttcagaacgtctgctaaatcgagaaccggtcgtgtatatactggtctgatggcgcgagggaggcgatacg

SEQ ID NO: 790031 - DNA, 670 bp, Homo sapiens
  misc_feature: 4844.UNK.UNK.UNK.pb.heavy.1.raw 4844
ctatgcgccttgccagcccgcctcagacagtatatagaagtagtccttgaccaggcagccagggccgctgtgctctcggaggtgctcctggagcagggcgccagggggaagaccgatgggcccttggtggagcctgaagagacggtgaccattgtcccttggccccagatatcaaagccactcacataaccaccacttttataatagttgatcatgtgttgcgcagtagtatgtggctgtgtccgcaggggccatttgtggccactctaaggatcacctgcgtattggaggcgtctccggtgatggagagtctgctcttcagagatggactgtagcgcctatcatcatcccaataaatgagtgcaagccactccagggccttcctgggggctgacggacccagcccacaaatcgctccatcactcctgagtgagaaccccagagaggttgcaggtcaagcgtgagggtctgtgtgggcttcaccagcgtaggaccagagactccttcagggtgatctgggacaagaccccatgaagggatggtcagcagcaggagcgtggagcaaagtgtgtccatggtggggcacaggagtcccccctttcccttcgtagcaccttaaatcgagcaccggtcgtgtatatactgtctgatgcgcgagggaggcgatacg

SEQ ID NO: 790032 - DNA, 690 bp, Homo sapiens
  misc_feature: 4852.44.36.D03.1.pb.heavy.1.raw 4852
ctatgcgccttgccagcccgctcagacagtatataggagtagtccttgacaggcagcccaggccgcgtgctctcgagtgccctggagcagggcgcagggggaagaccgatgggcccttggtggaggctgaggagacggtgaccagggttccccggccccagtagtcaaaccagccctgaccaagtgccccgatctctcgaacagaagtagaccccgtgtcctcgtctctcaggctgttcatttcagatacagtgagttcttggcattgtccctgaattggtgaatcggcccttcacagagtctgcgtagtaggtggtatctccagcaatattacatatgaaaaccactcccgccccttcctggagcctggcggacccagttcatggcatagtcactgaagatgaatccagaggctgcacaggagagtctcaggaccccccccgctgtaccaagcctccccagactccaccagccgcacctccagtggacaccttctaaatagcaacaaggaaacccagcgcagccccaactccatggtgagtcctctgtgttcagtgctgtcaccaagtgaaatggccttggaatccagggctaaggcaccctctgagagctcccaagagagatcgtgacgcagctaaatcgagcaccggtcgtgtatatactgtctgatggcgcgagggaggcgatacg

SEQ ID NO: 790033 - DNA, 658 bp, Homo sapiens
  misc_feature: 4865.44.86.H09.1.pb.heavy.1.raw 4865
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctggcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaaccgcttctccctgaaaactgacctccgtgaccgccgcggacacggccgtttatttctgtgcgaggcgagactggtctttcaatctatggggccgtggcaccctggtcactgtctcctcagcttccaccaaggggcccatcggtcttccccctggcgccctgctccaggagcacctctggggcacagcggccctgggctgcctggtcaaggactacttcctatatactgtctgagcgggctggcaaggcgcatag

SEQ ID NO: 790034 - DNA, 698 bp, Homo sapiens
  misc_feature: 4886.UNK.UNK.UNK.pb.heavy.1.raw 4886
ctatgcgcccttgccagccccgctcagacagtatataggaagtagtccttgaccaggcagccaggccgctgtggcccagaggtgctcttggggagggtgccaggggggagaccgatgggcctcttggtggaggcggaggcgacggtgaccagggttccctggccccagaagtcaacgaataataaccactcgagcgccgacttgtctcgcacagtaatagacggccgtgtcgtcgcctctcaggttgttatttgaagataaaccgtgttcctggaattgtccctggagatggtgaatcggccctttcacggagtctgcgtagtatgtgaatcaccagtataaatgactgggacccactccagccccttcctggagcctggcggacccaactcatgtagttgctgctgacggtgagccagagggctgcacaggagagtctctgggaccccccaggctggactaaggcctcctccagactccatcagccgcacctcacactggacacccttttaaagtccaacaaggagaaccagctcagccaagaactccatggtgagtcctctgtgttcagtgctgatcaccgaatggaaacacctcggaatccaagtgctgggctccttccccccaacgcaacgtgcgagtgctaatcgagcacgccccgtgtgtatatactgtctgatgggcgaggaggcgatacg

SEQ ID NO: 790035 - DNA, 750 bp, Homo sapiens
  misc_feature: 4923.UNK.UNK.UNK.pb.heavy.1.raw 4923
cgtatcgcctccctccgcgcgcgccatcagacgtatatacacgaccggtgctcgattttagaggtgaaggctcgttgggttttggggagctctgggagaggagcccaggcaccagaagtcggcggtgtttccagtcggtgatcagcacgaacacagagactcaccatggagtttgggctgacctgggttttcctcgttgctcttttaaggaggtgtccagtgtcaggtgagctggtgaggtctggggggagcgtggtccagcctgggaggtccctgagactctcctgtgtagcggtctggattcaccttcaacagacatggcatgcactgggtccgccaggcctcgcaggcaagggactgagtggggtggcacttatatggtatgatggaagttaataaatattagtgagattcccgtgaaggggccgattcaccatctccagagacaattcgaagaacggacactatatctggaaatggaatagcctggagagccgaggacacggcctgtctactactgtgcgagagatggggctcgtgggatacagaatatgacatgctctactccaattggtatggacgcctggggcaagggaccacggtcgccgtctcctcagcctccaccaagggcccatcggtcttcccctggcgcaccctcctccaagagcacctctgggggcacagcggccctgggctgcctggtcaaggactacttcctatatactctgagcgggctggcaaggcgcatag

SEQ ID NO: 790036 - DNA, 608 bp, Homo sapiens
  misc_feature: 4949.UNK.UNK.UNK.pb.heavy.1.raw 4949
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcaccccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcggttccgcagcttttgacctggaccagggtgcatagcctgcccagccttc

SEQ ID NO: 790037 - DNA, 700 bp, Homo sapiens
  misc_feature: 4971.44.27.C05.1.pb.heavy.1.raw 4971
ctatgcgccttgccagcccgctcagacagtatataggaagtagtccttgaccaggcagccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactggggccacgcctccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagcccaaacccttcgatcgcgtctaaatcgagcaccggtcgtgtatatctgtctgatggcgcgagggaggcgatacg

SEQ ID NO: 790038 - DNA, 626 bp, Homo sapiens
  misc_feature: 4994.44.23.C01.1.pb.heavy.1.raw 4994
ctatgcgccttgccagcccgctcagacagtatataggaagtagtccttgaccaggcagcccagggccgctgtgcccccagaggtgctcctggagcagggcggccagggggaagaccgatgggccttggtggaagctgaggagacagtggaccagggtgccacggcccatagattgaaaggaccagtctcgcctcgcacagaaataaacggccgtgtccgcggcgggtcacggaggtcagtttcaggggagaagcggttcatggacgtgtccctcgaaaatggtgagacgacctcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgttcaccctgccccaatccctaatcacgtgtactaaatcgagcaccggtcgtgtatatactgtctgatggcgcgagggaggcgatacg

SEQ ID NO: 790039 - DNA, 714 bp, Homo sapiens
  misc_feature: 4996.UNK.UNK.UNK.pb.heavy.1.raw 4996
cgtatcgcctcccctccgcgccatcagacagttttatccaacgacggtggctcgatttagcactcgcacgttggtttgggggggagaggagcccagcactggattccgagggttttccattcggtgatcagcactgaacacagaggactcaccatggagttttgcctgagctgggttctccttgttggacttttaaaaggtgtcccagtgtgaggtgcggctgatgggtctggaggaggctttagtcccagcctgggggtcccagagactcctccctgtgcagcctctgggctcaccgtcagccagcaactacatgagttgggtccgccaggctccagggaagggggctggagtgggtcctcagtcatttatactggtgatttttacatactacgcagactccgtgaagggccgattcaccatctccaggacaattccaggaacacggtttatcttcaatgaacaacctgagaggcgacgacacggccgtctattactgtgcgagacaagtcggcgctcggagtggttattattcgtttgacttctggggccaggaaaccctggtcaccgtcgcccccgcctccacaaggcccatcggtcttccccctgggcaaccctcctccaagagcacctctgggggcacagcggccctggctgcctggtcaaggactacttccctatattactgtctgagcggggctggcaaggcgcata

SEQ ID NO: 790040 - DNA, 685 bp, Homo sapiens
  misc_feature: 5014.44.45.E01.1.pb.heavy.1.raw 5014
ctatgcgccttgccaggcccgcctcagacagtatataggaagtagtccttgaccaggcagcccagggccgctgtgctctcggaggtgctcctggagcagggcgccagggggaagaccgatgggcccttggtggaggctgaggagacggtgaccagggctccctggccccagtagaacgatgggcctcgtacaataatagagagccgagtcccggctctcaaattgttcattgtagatacacggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcagggacgtcccaggctggaccacgcctcccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggccgcgagggaggcgatacg

SEQ ID NO: 790041 - DNA, 602 bp, Homo sapiens
  misc_feature: 5045.UNK.UNK.UNK.pb.heavy.1.raw 5045
gaaggctgggcaggctatgcaccctggtccaggtcaaaagctgcggaacccgcagcggccatcttggccactaggggtcgccgcagattcatattgtcgtctagcatgcacaatgctgcaaaccagcttgcaatgccacagccaagcggccaatctttacgccacgttgaattgtttattacctgtgactggctatggcttgcaacgccactcgtaaaactagtactttgcggttaggggaagtagacaaacccattactcacttcccggaagttcaactcattccaacacgaataaaagtaactcaacaccccaaggcaggctatgtgggggtgataggggtggattcctatttcctatccatcccctaggatctcaataagttactagcgagttaaatgtctgtagcgatcccgtcagtcctatcgcgcgcatcaagacctggttggttgagcgtgcagtagatcatcgataagctgcgagttaggtcatccagaccgcatctggccggcctaacgttcagtgtagctaaggcgtcaccttcgactgtctaaaggcaatatgtcgtcctttagctccaagtcccttagcaagcgtgtcgg

SEQ ID NO: 790042 - DNA, 650 bp, Homo sapiens
  misc_feature: 5057.UNK.UNK.UNK.pb.heavy.1.raw 5057
ctatgcgccttgccagcccgctcagacagtatataggaagtagtccttgaccaggcagccagggccgctgtgccccagaggtgctcctggagcagggcgccagggggaagaccgatgggcccttggtggaagctgaggagacagtgaccagggtgccacggccccatagattgaaaagaccagtctcgcctcgcacagaaataaacggccgtggtccgcggcggtcacggaggtcagttcagggagaagcggttcatggacgtgtcctcgaaatggtgagacgactcttgagggacggagagtagtacgtcgccccagtataatggatgtcaccaatccactccattcccctccctggggggctgccggatccaggccccaagaatgatcagaactgatggaaactccagagacagtgcagatgagagacagggttccgaaggctcaccgtcctggcccgactcctgcagctgcacctgggacaggaccatctggagctgccaccagcaggaggaaaaaccacaggtgcttcatgttcttgccacaggggtccttgactctcagaaaagcatccccaaacccaagtctatagcactaatcgagcaccgggcgcgtgtatatactgtctgatggcgcgaggaggcgatacg

SEQ ID NO: 790043 - DNA, 705 bp, Homo sapiens
  misc_feature: 5065.UNK.UNK.UNK.pb.heavy.1.raw 5065
cgtatcgcctccctcgcgccatcagacagtatatacacgacggtgctcgatttagcactcgcacgttgggtttggggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattgctgtgcgagacaagtcggcgctcggagtggttattattcgtttgacttctggggccagggaaccctggtcaccgtcgcctccgcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 790044 - DNA, 697 bp, Homo sapiens
  misc_feature: 5069.44.55.E11.1.pb.heavy.1.raw 5069
ctatgcgccttgccagcccgctcagacagtatataggaagtagtccttgaccaggcagcccagggccgctgtgccccagaggtgctcttggaggagggtgccaggggaagaccgatgggcccttggtggaggcggaggcgacggtgaccagggttccctggccccagaagtcaaacgaataataaccactccgagcggccgacttgtctcgcacagtaatagacggccgtgtcgtcgctctcaggttgttcatttgaagataaaccgtgttcctggaattgtcctggagatggtgaatcggcccttcacggagtctgcgtagtatgtgaatcaccagtataaatgactgagaaccccactcagccccttcctggagcctggcggacccaactcatgtagttgctgctgacggtgagcccagaggctgcacaggagagtctctgggacccccaggctggactaagcctcctcagactccatcagccgcacctcacactggacaccttttaaaagtccaacaaggagaccagctcagccaaaactccatggtgagtcctctgtgttcagtgctgatcaccgaatggaaacaccttcggaatcccagtgctgggcctcctctccccaaacccaacgtgcgagtgctaaatcgagcaccggtcgtgtatatactgtctgatggcgcgagggaggcgatacg

SEQ ID NO: 790045 - DNA, 703 bp, Homo sapiens
  misc_feature: 5073.44.67.G01.1.pb.heavy.1.raw 5073
cgtatcgcctccctcgcgccatcagacagtatatacacgaccggtgctcgatttagagtatacatattgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggggtccagagactctcctgtgcagcctctgggctcaccgtcagcagcaactacatgagttgggtccgccaggctccagggaaggggctgagtgggtctcagtcatttatactggtgatttcacatactacgcagactccgtgaaggccgattcaccatctccagggacaattccaggaacacggtttatcttcaaatgaacaacctgagaggcgacgacacggccgtctattactgtgcgagacaagtcggcgctcggagtggttattattcgttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 790046 - DNA, 705 bp, Homo sapiens
  misc_feature: 5078.44.56.F01.1.pb.heavy.1.raw 5078
cgtatcgcctccctcgcggccatcagacagtatatacacgaccggtgctcgatttagcagacgtctgaacacacaaagggctggagaggagcccagccgtgagattcccaggagtttccacttggtgatcagcactgagcacagaccaccaaccatggagttgggctaatcttgattttccttgtagtttttttagaaggtgtccagtgcgagggcgactggcggagtcggggggggcttggcacagccagggcggtctctgagactctcctgtgtagtctcaggattcagtcttagtgattatcacttgcctgggtccgtcaggctccagggaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccaggggacaatggtcaccgtctcttcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 790047 - DNA, 728 bp, Homo sapiens
  misc_feature: 5132.44.27.C05.1.pb.heavy.1.raw 5132
ctatgcgccttgccagcccgcttcagacagtatataggaaagtagtccttgaccaggcaagcccagggccgctgtggctctcggaggtgctcctggagcagggcgccaggggggaagaccgatgggcccttggtggaggcgtaggagacggtgaccagggttccctggcccccaggcgtcgaatgaaccgattttggaaaacagatagtctcgcacaaaatacacggccggtgtcctgaggtctcaggctgttcatttgaagagacactgtgttctcggaattgtctctggagatggtgaatcgggccctcaacggaatcaccgtagacttgatttcctccatgaaatgacacacctgccacccactccagcccctcgcctggagcctggcggacccactgcatattccaattatcgaaggtgaatccagaggctggcacaggagagtctcagggacctgccctcccctactggggcccgcctccgctcctcagactccacgaattgcacctgacacatgacacctcttaagagggcagacgaggaaacccagctcagcccaaactccatggtgagtcctctgctgttcagtttgatgatcaccgagtgaaacaccggcgacttccagtgcggggctccgtctcccaggaccccaaacccttcgatcgcgtctaaatcgagcaccggtcgtggtatatactgtctgatggcgcgagggaggcgatacg

SEQ ID NO: 790048 - DNA, 688 bp, Homo sapiens
  misc_feature: 5140.44.74.G08.1.pb.heavy.1.raw 5140
cgtatcgcctccctcgcgccatcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactgtgcagtctgggactagaatgccgcaaccttggtcctcggtgaccctttcctgcacggcctctggaagtactaccagttcactacttataccatcaactgggtgcgccaggccctggacaagggcttgagtggatgggtggaatcatccctctttttggctcactcacctacgcacgagacttccggggcagaattacgataccgcggacaagtccacagacacagtctccatgacaatgagttctttgaaatccgacgacacggccgtctactactgtgcgagaggtccgtaccccagctcgcatggagcctttgagatctggggcagggaaccctggtcattgtcacctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 790049 - DNA, 611 bp, Homo sapiens
  misc_feature: 5147.UNK.UNK.UNK.pb.heavy.1.raw 5147
cccgacacgcttgctagggacttggagctaaggacgacatattgcctttagacagtcgaaggtgacgccttagctaccactgaacgtttaggcgccagatgcggtctggggatgacctaactcgcagcttatcgatgatctactgcacgctcaacccaaccaggtcttgatgcgcgcgataggactgacggatcgctacagacatttaactcgctagtaacttaattgagatcctaggggatgggataggaaatagaatccacccctatcacccccccacatagcctgcttgggcgtgttgagtttacttttatttcgtgttggaatgagttgaacttccgggaagtggagtaatgggtttgtctacttcccctaaccgcaaagtactagttttacgagtggcgttgcaagccatagccagtcacaggtaaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 790050 - DNA, 676 bp, Homo sapiens
  misc_feature: 5161.44.45.E01.1.pb.heavy.1.raw 5161
ctatgcgcctgccagcccgctcagacagtatataggaagtagtccttgaccaggcagcccagggccgctgtgctctcggaggtgctcctggagcagggcgccagggggaagaccgatgggcccttgtggagctgaggagacggtgaccagggcctccctggccccagtagaacgatgggctcgtacaataataggagccgagtcctcggctctcaaatgttcattgtagatacacggtgttcttggattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcagggacgtcccaggctggaccacgcctcccccagactccaccagctgaacctgacactggacacctcttaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 790051 - DNA, 680 bp, Homo sapiens
  misc_feature: 5180.UNK.UNK.UNK.pb.heavy.1.raw 5180
cgtatcgcctcctcgcgccatcagacagtatatacacgaccggtgctcgattagctgcgtcacattctcttggggagctctgagagcggagccccagcccagattcccaggtgtttcatttggtgatcagcactgaacacagaggactcaccatggagttcggctgagctgggttttccttgttgttattttacaaggtgtccagatgtgaagtgcagttgggtggagtccgggagacttggtcagcctggaggtccctgagactctctgtgtcgcctctggattcaccatcagtgaccactatatggactggtccgccaggctccagggaaggggctgagtggctgccgcagtaaaacaagttgccagctttatcacagagtacgccgcgtctgtgaaagccagattcaccctctcaagagatgacttcagaactcattgattctgcgaatgactaacctgaaaaccgaggacacgggcatgtattattgtgttgtgtttatatcaggaactgtccactggggccaggaaccctggtcaccgtctcctcagcctccaccaaggcccatcggtcttcccctggcgccctgctccaggagcactccgagagcacagcggccctggctgcctggtcaaggactacttcctatatactgtctgagcgggctgcaggcgcatag

SEQ ID NO: 790052 - DNA, 689 bp, Homo sapiens
  misc_feature: 5215.UNK.UNK.UNK.pb.heavy.1.raw 5215
ctatgcgccttgccagcccgctcagacagtatataggaagtagtccttgaccaggcagcccagggccgctgtgctctcggaggtgctcctggagcagggcgccagggggaagaccgatgggccttggtggaggccgaggagacggtgaccagggttccctggcccaggcgtccgaatgaaccgattttggaaaacagatagtctcgcacaaaaatacacggccgtgtcctgaggtctcaggctgttcattttgaagagacactgtgttctcggaattgtctctggagatggtgatcggccctcaacggaaatcaccgtaacttgatttcctccatgaaatgacacacctgccacccactccagcccctcgcctggagcctgggcggacccactgcatattccaatatcgaaggtgaatccagaggctgcacaggaggagtctcagggacccccctactgggggccacgcctcccccagactccacgattgcaacctgacacatgacacctcttaagagggcaacgaggaaaacccagctcagcccaaactccatggtgagtcctctgtgttcagtgatgatcaccgagtggaaacaccgcgactttcctcttcccccccaaaccttcgatcgcgtctaaatcggcaccggtcgtgtatatactgtctgatgcgcgagggaggcgatacg

SEQ ID NO: 790053 - DNA, 706 bp, Homo sapiens
  misc_feature: 5245.44.55.E11.1.pb.heavy.1.raw 5245
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggcccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgaggaggcgatacg

SEQ ID NO: 790054 - DNA, 715 bp, Homo sapiens
  misc_feature: 5254.UNK.UNK.UNK.pb.heavy.1.raw 5254
ctatgcgccttgccagcccccgctcagacagtatataggaagtagtccttgaccaggccagcccagggccgctgtgctcctcggaggtgctcctggagcagggcgccagggggaagacgatggggcccttgtggaggcctgaggagacggtgaccagggttccctggcccccagtgggcagttcctgtataaacacaaacaataatacatgcccggtcctccggttttcaggttagtcattcgcagaatcaatgagttcttgaagtcatctcttgagagggtgaatctggctttcacagacgcgggcgtactctgtgataaagctgggcaactttgtttttactgcggcgcaagccactccagccccttccctggagcctggcgcggacccagtccatatagtggtcactgatggtgaatccagaggcgacacaggagagtctcagggaccctccaggctggaccaaagtctcccccggactccaccaactgcacttcactctggacacctgtaaaataacaacaagaggaaaaccccagtcagcccgaactccatggtgagtcctctgtgttcagtggctgatcaccaaatgaaaaacacctgggaattctgggctggggctccgctctcagagctcccaagagagatcgtgacgcagctaaatcgagcacccgtcgtgtatatactgtctgatggcgcgagggaggcgatacg

SEQ ID NO: 790055 - DNA, 681 bp, Homo sapiens
  misc_feature: 5276.44.71.G05.1.pb.heavy.1.raw 5276
cgtatcgcctccctcgcgccatcagacagtatatacacgaccggtgctcgatttagtgtcgtcgcaagagagaggagcccagccgtgagattccaggagtttccacttggtgatcagcactgagcacagaccaccaaccatggagtttggctaatcttgattttccttgtagtttttttagaaggtgtccagtgcgagggcgactgcggagtcgggggggggcttggcacagccagggcggtctctgagactctcctgtgtagtctcaggattcagtcttagtgattatcacttggcctgggtccgtcaggctccagggaagggcttgagtgatcactttcgtcagaatgaaacgttatggtggaagtaaagagtacgcgcgtctgtgaagggaagattcaccgtctcaagggatgactccacagtgttggccatttacaaatgagcaacctgagacccgacgacacaggcgtctattactgcgccaggcgatcctggacgtcgatgcatttgatattggggccagggacaatggtcaccgtctcttcagcttccaccaagggcccatcggtcttcccctggcgcctgctccaggagcacctctgggggcacagcggccctgggctgcctggtcaaggactacttcctatatactgtctggcgggctggcaaggcgcatag

SEQ ID NO: 790056 - DNA, 703 bp, Homo sapiens
  misc_feature: 5283.44.55.E11.1.pb.heavy.1.raw 5283
cgtatcgcctccctcgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggtctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccaggaaccctggtcaccgtcgcctccgcctccaccaagggcccatcggtcttcccctggcaccctcctccaagagcacctctggggcacagcggccctgggctgccctggtcaaggactacttcctatatactgtctgagcgggctggcaaggcgcatag

SEQ ID NO: 790057 - DNA, 651 bp, Homo sapiens
  misc_feature: 5307.44.12.B01.1.pb.heavy.1.raw 5307
ctatgcgccttgccagcccgctcagacagtatataggaagtagtccttgaccaggcagcccaggccgctgtgcccccagaggtgctcttgaggagggtgcaggggaagaccgatgggcccttggtggaggctgaggagacggtgaccagggttccctggcccagtgtcaaagtagttggtgacgaactgccctactctcgcacagtaatacacggccgtgtccgcggcggtcacagagctcagcttcagggagaactggtcttggacgtgtctactgatatggtgactcgactcttgagggacgggttgtagtaggtgctcccactataatagatactcccaatccactccagccccttccctgggggctgcggatccagccccagtagtaactactactgctgatggagccacagagacagtgcaggtgagggacagggtctccgaaggcttcaccagtcctgggcccgactcctgcagctgcagctgggacaggacccatctgggagccgccacagcaggagaagaaccacaggtgcttcatgttcttgcacaggaggtccatgactctcagaaagccccgcggaatctacactactaaatcgagcaccggtcgtgtatatacgtctgatggcgcgaggaggcgatacg

SEQ ID NO: 790058 - DNA, 701 bp, Homo sapiens
  misc_feature: 5321.44.56.F01.1.pb.heavy.1.raw 5321
cgtatcgcctccctcgcgccatcagacagtatatacacgaccggtgctcgatttagcagacgtctgaacacacaaaggggagctctgggagagagccccagccgtgagattcccaggagtttccacttggtgatcagcactgagcacagaccaccaaccatggagttgggctatcttgattttccttgtagttttttagaaggtgtccagtgcgagggcgactggcggagtcggggggggcttggcacagccagggcggtctctgagactctcctgtgtagtctcaggattcagtcttagtgattatcacttggcctgggtccgtcaggctccagggaaggggcttgagtggatcactttcgtcagaatgaaacgttatggtggaagtaaagagtacgccgcgtctgtgaagggaagattcaccgtctcaaggatgactccaacagtgttggccatttacaaatgagcaacctgagacccgacgacacaggcgtctattactgcgccagcgatcctgggacgtcgatgcatttgatatttggggccaggggacaatggtcaccgtctcttcagctccaccaggggccatcggtcttcccctggcgccctgctccaggagcacctctgggcacagcggccctgggctgcctggtcaagactacttcctatatactgtctgagcgggctggcaaggcgcatag

SEQ ID NO: 790059 - DNA, 704 bp, Homo sapiens
  misc_feature: 5351.UNK.UNK.UNK.pb.heavy.1.raw 5351
ctatgcgccttgcccaggcccgctcagacagtatatagggtagtccctttgaccaggcagcccagggccgctgtgctctcggaggtgctcctggagcaggcgccagggggaagaccgatgggcccttgtggaggctgaggagacggtgaccagggttccctggccccagtggacagttcctgatataaacacacacaataatacatgcccgtgtccctcgttttcagttagtcattcgcagaatcaatgagttcttgaagtcatctcttgagagggtgaatctggctttcacagacgcggcgtactctgtgataaagctggcaactttgtttttactgcggccaagccactccagccccttcctggagctgcggacccagtccatataggtggtcactgatggtggaatccagaggcgaccacaggagagtctcagggaccctcgcaggctggaccaagtctccccggactccaccaactgcacttcactctggacacacctgtaaaataacaacaacgaaaacccagctcagccccgaactccatggtgagtcctctgtgttcagtgctgatcaccaaatgaaaaacacctggaattctgggctggggctccgctctcagggctcccaagagagatcgtgacgccagctaaatcgagcaccggtcgtgtatatactgtctgatggcgcgagggaggcgatacg

SEQ ID NO: 790060 - DNA, 670 bp, Homo sapiens
  misc_feature: 5356.UNK.UNK.UNK.pb.heavy.1.raw 5356
cgtatcgcctccctcgcgccatcagacagtatatacacgccggtgctcgatttagtagtgtagattccgcgggggctttctgagagtcatggacctcctgtgcaagaacatgaagcacctgtggttcttcctcctgctggtggccggctcccagatgggtcctgtcccagctgcagctgccaggagtcgggcccaggactggtgaagccttcggagaccctgtccctcacctgcactgtctctggtggctccatcagcagtagtagtttactactggggctggatccgccagtcccagggaaggggctggagtggattgggagtaatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtcttcctcagcctccaccaagggcccatcggtcttccccctggcaccctcctccaagagcacctctgggggcacagcggccctgggctgccttggtcaagggactacttcctatatactgtctgagcgggctggcaaggcgcatag

SEQ ID NO: 790061 - DNA, 687 bp, Homo sapiens
  misc_feature: 5380.44.73.G07.1.pb.heavy.1.raw 5380
cgtatcgcctcctcgcgccatcagacagtatatacacgaccggtgctcgatttagctctacgctcagggccgctgtgctctcggcggtgtttccattcggtgatcagcactgaacacagaggactcaccatggagtttgggctgagctgggtttttcctcgttactcttttaagaggtgtccagtgtcaggtgcacctggtggagtctgggggaggcgtggtccagcctgggaggtccctgagactctcctgtgaagcctctggatttagtttcagtagttctggcatgcactgggtccgccaggctccaggcaagggccggagtggttggcagttatagcatatgatggaacttctagatattatgcagactccgtgaagggccgattcaccatctccagagacaattcccggaacactctgtacctggaaatgatcagccctgagaggcgaggactcggctctgtattactgtgcgagatcgggaagtggcagcagctattatcgggccgtttcactggggccaggggacactggtcaccgtctcctcagcctccaccaagggcccatccggtcttccccctggcgccctgctccaggagcacctccgagagcacagcggccctgggctgcctggtcaaggactacttcctatatactgtctgagcgggctggcaaggcgcatag

SEQ ID NO: 790062 - DNA, 548 bp, Homo sapiens
  misc_feature: 5391.UNK.UNK.UNK.pb.heavy.1.raw 5391
cgtatcgcctccctcgcgccatcagacagtatatacacgaccggtgctccgatttagactagcagtaaggggctgaggtgaagaagcctgggcctcagtgaaggtctcctgcaaggcttctggatacaccttcaccaattatgatatcaactgggtgcgacaggccactggacaagggcttgagtggatgggatggatgaaccctaacagtggtaacacagctatgcacagaagttccagggcagagtcaccatgaccaggaacacctccataaacacagcctacatggagctgagcagcctgagatctgaggacacggccgtgtattactgtgcgagatccgaaagtatagcagctcgtcggggaggtggttcgacccctggggccagggaaccctggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 790063 - DNA, 710 bp, Homo sapiens
  misc_feature: 5446.44.36.D03.1.pb.heavy.1.raw 5446
cgtatcgcctccctcgcgccatcagacagtatatacacgaccggtgctcgatttagctgcgtcacgatctctcttggggagctctgagagcggagcccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgccttctggattcaccatcagtgaccactatattggactgggtccgccaggctccagggaaggggctggagtggcttggccgcagtaaaaacaaagttgccagctttatcacagagtacgccgcgtctgtgaaagccagattcacccttctcaagagatgactttcaagaactcattgattctgcgaatgactaacctgaaaaccgagggacacgggcatgtattattgtgttgtgtttatattcaggaactgtccactggggccagggaaccctggtcaccgtctcctcagcctccaccaagggcccaatcggtcttcccctggcgccctgctccaggagcacctccgagagcacagcggccctgggctgcctggtcaaggactacttcctatatactgtctgagcgggctggcaaggcgcatag

SEQ ID NO: 790064 - DNA, 620 bp, Homo sapiens
  misc_feature: 5448.UNK.UNK.UNK.pb.heavy.1.raw 5448
ccgacacgctgctagggacttggagctaaggacgacatattgcctttagacagtcgaaggtggacgccttagctaccactgaaacgtttaggcgccagatgcggtctgggatgacctaactcgcagctttatcgatgatctactgcacgctcaaccaaccaggtcttgatgcgcgcgataggactgacgggatccgctacagacatttaactcgctagtaacttaattgagatcctaggggatgggataggaaatagaatccacccctatcaccccccccacatagcctgcttggggtgttgagtttacttttatttcgtgttggaatgagttgaacttccgggaagtgggagtaatgggttttgtctacttcccctaaccgcaaagtactagttttacgagtggcgttgcaagccatagccagtcacaggtaataaaacaattcaacgtggcgtaaaagattggccgcttgcttgggggcattggccaagctggggtttgcagcattgtgcatgctagacgacaatatgaatctgcgggacccctagtggccaagatggccgctagcgggttccgccagcttttgacctggaccagggtgcatagcctgcccagccttc

SEQ ID NO: 790065 - DNA, 594 bp, Homo sapiens
  misc_feature: 5470.44.27.C05.1.pb.heavy.1.raw 5470
cgtatcgcctccctcgcgccatcagacagtatatacacgaccggtgctcgatttagacgcgatcgaagggtttggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtattttttgtgcgagactatctgtttccaatcggtcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagc

SEQ ID NO: 790066 - DNA, 728 bp, Homo sapiens
  misc_feature: 5472.44.33.C11.1.pb.heavy.1.raw 5472
cgtatcgcctccctcgcgccatcagacagtatatacacgaccggtgctcgatttagagtgagctcgttgggtttggggagctctggagaggagcccagcaccagaagtcggcggtgtttccagtcggtgatcagcaccgaacacagaggaactcaccatggagtttgggctgacctgggttttcctcgttgctctttaagaggtgtccagtgtcaggtgaagctggtggagtctggggaggcgtggtccagcctgggaggtccctgagactctcctgtgtagcgtctggattcaccttcaacagacatggcatgcactgggtccgccaggctccaggcaagggactggagtgggtggcactatatggatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtctttccccctggcaccctcctccaagagcacctctgggggcacagcggccctgggctgcctggtcaaggactacttcctatatactggtctgagcgggctggcaaggcgcatag

SEQ ID NO: 790067 - DNA, 688 bp, Homo sapiens
  misc_feature: 5484.UNK.UNK.UNK.pb.heavy.1.raw 5484
ctatgcgccttgccagcccgctcagacagtatataggaagtagtccttgaccaggcagcccagggccgctgtgccccagaggtgctcctggagcagggcgccagggggaagaccgatgggcccttggtggaagctgaggtgacaatgaccagggttccctgcccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgcccggaagtctcgtgcgtaggtgagtgagccaaaaagagggatgattccacccatccactcaagcccttgtccaggggcctggcgcacccagttgatggtataagtagtggaactggtagtacttccagaggccgtgcaggaaagggtcaccgaggaccaaggttgcggcattctagtcccagactgcaccagttgcaccagggactggacacctgttgctgctgccaccacaaagaggaacctccaggtccagtccatggtgatgagctgtgctcccaggggcttctttagaggaggaatgtggttgttatgtgatgctcccctgatagagctactaaatcgagcacggtcggtatatactgtctgatggcgcgaggaggcgatacg

SEQ ID NO: 790068 - DNA, 650 bp, Homo sapiens
  misc_feature: 5502.44.86.H09.1.pb.heavy.1.raw 5502
cgtatcgcctccctcgcgccatcagacagtatatacacgaccggtgctcgatttagtgctatagacttgggtttgggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggagggaatggagtggattgtgacatccattataactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcatctatggggccgtggcaccctggtcactgtctcctcagcttccaccaagggcccatcggtcttccccctggcgccctgctccagagcacctctgggggcacagcggcccctgggctgcctggtcaaggactacttcctatatactgtctgagcgggctggcaaggcgcatag

SEQ ID NO: 790069 - DNA, 594 bp, Homo sapiens
  misc_feature: 5564.44.23.C01.1.pb.heavy.1.raw 5564
cgtatcgcctcctcgcgccatcagacagtatatacacgaccggtgctcgatttagtacacgtgattagggattgggcagggtgaacactgtggtttttcctcctgctggtggcagctccagatgggtcctgtcccaggtgcagctgcaggagtcggccagactggtgaggcttcgggaaccctgtctctcatctgcactgtctctggagtttccatcagttctgatcattctgggctggatcggcagccccaggaggggaatggagtggattggtgacatccattatactggggcgacgtactactctccgtcctcaagagtcgtctcaccatttcgagggacacgtcatgaaccgcttctccctgaactgacctccgtgaccgccgcggacacggccgttatttctgtgcgaggcgagactggtctttcatctatgggccgtgcacctggtcactgtctctcagcttccaccaagggcccatcggtcttcccctggcgcctgctccaggagcactctggggcacagcggcctggctgcctggtcaaggactacttcctatatactgttctgagcgggctggcaaggcgcatag

SEQ ID NO: 790070 - DNA, 641 bp, Homo sapiens
  misc_feature: 5581.UNK.UNK.UNK.pb.heavy.1.raw 5581
ctatgcgcctgccagccgctcagacagtatataggaagtagtccttgaccaggcagtcaggccgctgtgccccagaggtgctcctggagcagggcgccagggggaagaccgatgggccttggtggaagctgaggagacagtgaccaggcgtgcacgcccatagattggaaagaccagtctcgcctcgcaccagaaataaacggccgtgccgcgcggtcacgaggtcagtttcagggagaagcgttttcatggacgtgtccctcgaaaatgggagacgactctttgaggacggagagtagtacgtcgcgccagtataatggatgtccaccaatccactcattcctcctgggggctgcgcgatccagccccaagaaatgatcagaactgatggaaactccagagacagtgcgatgagagacagggtcccgaaggccctcaccagtcctgggcccgatcctgcagctgcacctgggacaggacccatctgggagctgcaccgagcaggaggaaaaccacaggtgccttcatgttcttgcacaggaggtccttggactctcagaagcatccccaaaccaagtctatagcactaaatcgagcaccggtcggtatatactgtgatggcgccgaggcgaggcgatacg

SEQ ID NO: 790071 - DNA, 544 bp, Homo sapiens
  misc_feature: 5583.UNK.UNK.UNK.pb.heavy.1.raw 5583
cgtatcgcctcccctcggcgccatcagacagcattacacggaccggtgctcgattagactagcagtaaggggcgaggtgaagagcctggggcctcagtggaaggtctcctgcaaggcttctggaacaccctcacaattatgatatcactggtgcgacagccccactggacaagggcttgagtggatggatggatgaacccctaacagtggtaacacaggctatgcacagaagttcaggcagagtcaccatgaccaggaacacctccataaacacagcctacatggagctgagcagcctgagatctgaggacacggccgtgtattactgtgcgagatcccgaagtatagcagctcgtcgggaggtggttcgacccctgggccagggaaccctggtcacccgtctcctcagcttccaccaagggcccatcggtcttccccctggcgccctgctccaggagcacctctggggcacagcggccctgggctgcctggtcaaggactacttcctatatactgtctgaagcgggctggcaaggccgcatag

SEQ ID NO: 790072 - DNA, 609 bp, Homo sapiens
  misc_feature: 5584.UNK.UNK.UNK.pb.heavy.1.raw 5584
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtacttttgcggttaggggaagtagacaaacccattactcccacttcccggaagttcaactcattccaacacgaaataaaagtaaactcaacaccccaagcaggctatgtggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 790073 - DNA, 720 bp, Homo sapiens
  misc_feature: 5609.44.85.H08.1.pb.heavy.1.raw 5609
cgtatcgcctccctcgcgccatcagacagtatatacacgaccggtgctcgatttagtatcactcagtcgcggggagctctggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggaggcgtggtccagcctgggaggtccctgagactctcctgtgcagcgtctggattcaccttcagtacctatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaagggcccatcggtcttccccctggcaccctcctccaagagcacctctgggggcacagcggccctggctgcctggtcaaggactacttcctatatactgtctgagcgggctggcaaggcgcatag

SEQ ID NO: 790074 - DNA, 608 bp, Homo sapiens
  misc_feature: 5615.UNK.UNK.UNK.pb.heavy.1.raw 5615
aggctgggcaggctatgcaccctggtccaggtcaaaagctgcggaacccgctagcggccatcttggccactaggcggtcccgcagattcatattgtcgtctagcatgcacaatgctgcaaacccagcttgcaatgcccacagcaaagcggcaatctttacgccaacgttgaattgtttattacctgtgactggctatggctttgcaacgccactcgtaaaaactagtacttttgcggttaggggaagtagacaaacccattactccacttccggaagttcaactcattccaacacgaaataaaagtaaactcaacacccaagcaggctatgtgggggggtgatagggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 790075 - DNA, 698 bp, Homo sapiens
  misc_feature: 5622.44.55.E11.1.pb.heavy.1.raw 5622
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcgcccttcacggagtctgcgtagtatgtgaaatcaccagtataaatgactgagacccactccagccccttccctggagcctggcggaccaactcatgtagttgctgctgacgtgagccagaggctgcacaggagagtctctgggacccccaggctggactaagcctcctccagactccatcagccgcacctcacactggacaccttttaaagtccaacaaggagaacccagctcagccaaaactccatggtgagtcctctgtgtcagtgctgatcaccgaatggaaacacctcggaatcccagtgctgggctcctctccccccaaacccaacgtgcgagtgctaaatcgagcaccggtcgtgtatatactgtctgatggcgcgagggaggcgatacg

SEQ ID NO: 790076 - DNA, 670 bp, Homo sapiens
  misc_feature: 5628.UNK.UNK.UNK.pb.heavy.1.raw 5628
ctatgcgccttgccagcccgctcagacagtatataggaagtagtccttgaccaggcagcccagggccgcgtgctctcggaggtgctcctgaagcagggcgccagggggaagaccgatgggcccttggtggaggctgaggagacgtgaccaggttccctgccgaatgaaaccatcccagacagtaatagacggctgtgtcctcggtgttcaggctgttcatctgcagagacaccgtatcttttgaatcatctcttgagatggtgaatctgcctttcacgggtgccagcgtagtctgctgtccaccgtcagcttttggttctatacggccaaccactccagcccttcctggagcctggcggacccaggtcatccaggcgttactgaaagtgaatccagaggctgcacaggagagtctagggactccccaggctttaccaaaccctcccccagactccacaactgcacctcacactggacacctttaaaatagcagcaggaaaatccagctcagcccaaactccatggtgagtcctctgtgttcagtcctgatcactgaatgaaaacacctgggaatcccaaggctggggctcctctcccagagctcaacacactctctctaaaatcgagcaccgtcgtgtatatactgtctgatggcgcgaggagcgatacg

SEQ ID NO: 790077 - DNA, 724 bp, Homo sapiens
  misc_feature: 5636.UNK.UNK.UNK.pb.heavy.1.raw 5636
cgtatcgcctccctcgcgccatcagacagtatatacacgacggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatgcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtctcccctggcaccctcctccaagagcacctctgggggcacagcggcctgggctgcctggtcaaggactacttcctatatactgtctgagcgggctggcaaggcgcatag

SEQ ID NO: 790078 - DNA, 706 bp, Homo sapiens
  misc_feature: 5662.44.27.C05.1.pb.heavy.1.raw 5662
ctatgcgccttgccagcccgctcagacagtatataggaagtagtccttgaccaggcagcccagggccgctgtgctctcggaggtgctcctggagcagggcgccaggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactgggccacgcctcccccagactccacgaattgcacctgacacatgacacctcttaagagggcaacgaggaaaacccagctcagcccaaactccatggtgaagtcctctgtgttcagtgatgatcaccgagtggaaacaccggcgacttccagtgctgggctcgtctcccagggctccccaaacccttcgatcgcgtctaaatcgagcaccggtcgtgtatatactgtctgatggcgcgaggaggcgatacg

SEQ ID NO: 790079 - DNA, 656 bp, Homo sapiens
  misc_feature: 5668.44.86.H09.1.pb.heavy.1.raw 5668
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaaccgccgcggacacggccgtttatttctgtgcgaggcgaggactggtctttcaatctatggggccgtggcaccctggtcactgtctcctcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 790080 - DNA, 699 bp, Homo sapiens
  misc_feature: 5711.44.55.E11.1.pb.heavy.1.raw 5711
ctatgcgccttgccagcccgctcagacagtatataggaagtagtccttgaccaggcagcccaggccgctgtgccccagaggtgctcttggaggagggtgccagggggaagaccgatgggcccttggtgaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggccttcacggagtctgcgtagtatgtgaaatcaccagtataaatggactgagacccactccagccccttccctggagcctggcggacccaactcatgtagttgctgctgacggtgagccccagaggctgcacaggagagtctctggacccccccaggctggactaagcctctccagactccatcagccgcacctcacactggacacctttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaaatcgagcaccggtcgtgtatatactgtctgatggcgcgagggaggcgatacg

SEQ ID NO: 790081 - DNA, 614 bp, Homo sapiens
  misc_feature: 5728.44.23.C01.1.pb.heavy.1.raw 5728
cgtatcgcctccctcgcgccatcagacagtatatacacgaccggtgctcgatttagtacacgtgattagggattgggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggaggggaatggagtggatggtgacatccattatactgggggcgacgtactactctccgtccctcaagagtcgtctcaccattttcgagggaccgtccatgaaccgcttctcctgaaactgacctccgtgaccgcgcggacacggccgttatttctgtgcgaggcgagactggtctttcatctatggggccgtggcaccctggtcactgtctcctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 790082 - DNA, 729 bp, Homo sapiens
  misc_feature: 5766.UNK.UNK.UNK.pb.heavy.1.raw 5766
ctatgcgccttgccagcccgctcagacagtatataggaagtagtccttgaccaggcagccccaggggccgctgtgccccccagaggtgctcttgggggagggtgccagggggaagaccgatggcgcccctttggtggaggctgaggagacggtgaccgtggtcccttggcccccagacgtccataccgtagtagtagtcccagcaggtggtagtactacaatatgtcctcgccacagtaatacacagccgtgtcctcggctctcaggctgttcatttgcagatacagcgtgttcttgaattgtctctggagatggtgaatcggcccttcacggagtctgcatagtatttatacttcatcataccatataagtgccacccactccagccccttgcctggagcctggcggacccagtgcatgccataggtactgaagggtgaatccagacgctgcacaggagagtctcagggacctcccaggctggacacgcctcccccagactccaccagctgcacctgaacactggacaccctcttaaaagagcaacgaggaaaacccagctcagcccaaactccatggtgagtcctctgtgttcagtgctgatcaccgaatggaaacacccgccgacttctagtgctggctcctctcccagagctccgcgactgagtgatactaaatcgagcaccggttcgtgtatatactgtctgatggcgcgagggaggcgatacg

SEQ ID NO: 790083 - DNA, 691 bp, Homo sapiens
  misc_feature: 5815.UNK.UNK.UNK.pb.heavy.1.raw 5815
ctatgcgccttgccagcccgctcagacagtatataggaagtagtccttgaccaggcagccagggccgctgtgccccagaggtgctcctggagcagggcgccaggggaagaccgatgggccttggtggaagctgaggagacggtgaccagggttccctggcccaggggttcgaaccaatttccatgtgtgggactatgagagggactatgaaagttgacgagggctctcgcacagaaatagatggccgtgtcttcagatctcagcctgctcagctccatgtaggctgtactcgtggattcgtccgcggtaatggtgactctgtcctgaaacttctgtgcgtaattcgatgcaccaaagatagggatgatccctcccagccactcaagcccttgtccaggggcctggtcgcacccaaataaaagcatagctgaagaaggtgccttccagaagccttgcaggagaccttcaccgaggaccaggcttcttcacctcagcccagactgccaccagctgcacctgggactggacacctgtagctgcctgccaccacaaagaggaaccgccaggtccagtccatggtgatgagctgtgctcccaggggcttctttagaggaggagtgtggttgttatgtgatcaaaatcgagcaccggtcgtgtatatactgtctgatggcgcgagggaggcgatacg

SEQ ID NO: 790084 - DNA, 695 bp, Homo sapiens
  misc_feature: 5816.44.27.C05.1.pb.heavy.1.raw 5816
cgtatcgcctccctcgcgccatcagacagtatatacacgaccggtgctcgatttagacgcgatcgaaggtttggggctgggagacgagccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggaggcgtggccccagtagggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgtgagggccgattcaccatctccagagacaattcgagaacacagtgtctcttcaaatgaacagcctgagacctcaggacacggccgtgtatttttgtgcgagactatctgttccaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790085 - DNA, 616 bp, Homo sapiens
  misc_feature: 5819.UNK.UNK.UNK.pb.heavy.1.raw 5819
gaaggctgggcaggctatgcaccctggtccaggtcaaaagctgcggaacccgctagcggccatcttggccactaggggtcccgcagattcatattgtcgtctagcatgcacaatgctgcaaacccagctttgcaatgcccacagcaagcggccaatctttacgccacgttgaattgtttattacctgtgactggctatggcttgcaacgcccactcgtaaaactagtactttgcggttaggggaagtagacaaacccattactccacttcccggaagttcaactcattccaacacgaaataaaagtaaactcaacaccccaagcaggctatgtgggggggtgataggggtggaattctatttcctaatcccatacccctaggatctcaattaagttactagcgagttaaatgtctgttagcgatccccgtcagtcctatcgcggccatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagttccctagcaagcgtgtcggg

SEQ ID NO: 790086 - DNA, 727 bp, Homo sapiens
  misc_feature: 5881.44.86.H09.1.pb.heavy.1.raw 5881
cttgcgccttgccagcccgctcagacagtatataggaagtagtccttgaccaggcagcccagggccgctgtgcccccagaggtgctcttggaggagggtgccaggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccaccccactccagtcccttgcctggagcctggcggacccagtgcatgccatgtctggttgaaggtgatccagacgctacacaggagagtctcagggacctcccaggctggaccacgcctccccagactccacagcttcacctgacactggacacctcttaaaagagcaacgaggaaacccaggtcagcccaaactcccatggtgagtcctctgtgttcgggtgctgatcaccgactggaaacaccgccgacttctggtgctgggctcctctcccagagctccccaaacccaagtctatagcactaaatcgagcaccggtcgtgtaatatactgctgatggcgcgagggaggcgaacg

SEQ ID NO: 790087 - DNA, 710 bp, Homo sapiens
  misc_feature: 5884.44.73.G07.1.pb.heavy.1.raw 5884
cgtatcgcctccctcgcgccatcagacagtatatacacgaccggtgctcgatttagctctacgctcaggggagctctgggagaggagcccagcactagaagtcggcggtgtttccattcggtgatcagcactgaacacagaggactcaccatggaggtttgggctgagctgggttttcctcgttactctttagaggtgtccagtgtcaggtgcacctggtggagtctgggggaggcgtggtccagcctgggaggtccctgagactctcctgtgaagcctctggatttagtttcagtagttctggcatgcactgggtcccgccaggctccaggcaaggggccggagtggttggcagttatagcatatgatggaacttctagatattaatgcagactccgtgaagggcccgattcaccatctccagagacattcccggaacactctgtacctggaaatgatcagcctgaggaggcgaggactcggctctgtattactgtgcgaagatcgggagtggcagcagctattatcgggcgtttcactggggccaggggacactggtcaccgtctcctcagcctccaccaagggcccatcggtctttccccctggcgccctgctccaggagcacctccgagagcacagccggccctgggctgcctggtcaaggactacttcctaatatactgtctgagcgggctggcaaggcgcatag

SEQ ID NO: 790088 - DNA, 670 bp, Homo sapiens
  misc_feature: 5896.44.35.D02.1.pb.heavy.1.raw 5896
cgtatcgcctccctcgcgccatcagacagatacacgaccggtgctcgatttagcacacgatagttgggtttggggatactttctgagactcatgggcctcctgcacaagaacatgaaacacctgtggttcttcctcctcctggtggcacctccagatgggtcgtgtccgaggtgcagctgcaggagtcgggcccaggacgggtgaagccttcggagaccctgtccctcacctgcaatgtctctggtggttacatcagtagttattattggagttggctgcggcagtccgccggaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggcgaactggctcgacccctggggccagggaaccctggtcaccgtctcctcagcctccaccaagggcccatcggtcttccccctggcaccctcctccaagagcacctctggggcacagcggccctgggctgcctggtcaaggactacttcctatatactgtctgagcggctggcaaggcgcatag

SEQ ID NO: 790089 - DNA, 740 bp, Homo sapiens
  misc_feature: 5908.UNK.UNK.UNK.pb.heavy.1.raw 5908
cgtatcgcctccctcgcgccatcagacagtatatacacgaccgtgctcgatttagtgctatagacttgggttggggagctctgggagaggagcccagcaccagaagtcggcggtgttttccagtcggtgatcagcaccgaacacagaggactcaccatggagtttgggcctgacctgggttttcctcgttgctcttttaagaggtgtccagtgtcaggtgaagctggtggagtctgggggaggcgtgtccagcctggggaggtccctgagactctcctgtgtagcgtctggattcgccttcaacagacatggcatgggcactgggtccgccaggctccaggcaagggactggagtgggtggcactttatatggtcatgatggagtaataaatattagtagattccgtgaagggccgattcaccatcttccagagacaatttcgaagaaacacactatatctggaaatgaatagctgagagccgagacacggctgtctaactactgtgcgagagatggggctcgtggatacagatatgacatgctctactccaatggtatggacgcctggggccaagggaccgacggtcgccgtctcctcagcctccaccaaagggcccatcggtcttcccctggcaccctcctccaagagccagcctctggggggcacagcggccctgggctggccctggtcaaggactaacgtcctatatactgtctgagcggctggcaaggcgcatag

SEQ ID NO: 790090 - DNA, 614 bp, Homo sapiens
  misc_feature: 5952.44.38.D05.1.pb.heavy.1.raw 5952
cgtatcgcctccctcgcgccatcagacagtatatacacgaccggtgctcgatttagtatctgatagctgggttttccttgttgctattttaaaaggtgtccagtgtgaggtgcagctggtggagtccgggggaggcttagttcagcctgggggtccctgagactctcctgtgcagcctcctggattcacctcagagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggcgtgtattactgtgcaagagccggtgcgggagttcggggagttgcatactactactacggtatggacgtctggggccaagggaccacggtcaccgtctcctcagcttccaccaagggcccatcggtcttcccctggcgccctgctccaggagcacctctgggggcacagcggccctggctgcctggtcaaggactacttcctatatactgtctgagcgggctggcaaggcgcatag

SEQ ID NO: 790091 - DNA, 706 bp, Homo sapiens
  misc_feature: 5979.44.27.C05.1.pb.heavy.1.raw 5979
cgtatcgcctccctcgcgcatcagacagtatatacacgaccggtgctcgatttagacgcgatcgaagggtttgggggctgggagacgagcccagcactggaagtcgccggtgtttccactcggtgatcatcactgaacacagaggactccaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790092 - DNA, 702 bp, Homo sapiens
  misc_feature: 5991.44.84.H07.1.pb.heavy.1.raw 5991
ctatgcgccttgccagcccgctcagacagtatataggaagtagtccttgaccaggcagccagggccgctgtgccccagagtgctcttggaggagggtgccagggggaagaccgatgggcccttggtggaggctgcggcgacggtgaccagggctccctggccccaggagttgaaccacccacccactgtggatccagtccccccctcttcgcacagaaataaagggccgtgtcttcgactctcaggctgttcatttccagaaaaagtgtgtttccggaattgtctctggagaggtgaagcggcccttcacggactctccgtagtatgtgtcagttgcactagcgccaattgtcgagaccactcgagccccttccctggagcctggcggacccaggtcatggcatagctcctaaagggaagccagaggctgcacaggagagtctcagggaccccccaggctgtgccaatcctcccagactccaacagggccacctcacactggacaccttttaaaatagtcacagaaaaagccacctcagccaaactccatggtgagttctctctgttcagtcctgatcaccaatgaaaacacctgaaaatcccagggctgggctcctctctcagagctccccgcgacagacgtctgctaaatcgagcaccggtcgtgtatatactgtctgatggcgcgagggaggcgatacg

SEQ ID NO: 790093 - DNA, 633 bp, Homo sapiens
  misc_feature: 5996.UNK.UNK.UNK.pb.heavy.1.raw 5996
cgtatcgcctccctcgcgccatcagacagtatatacacgacggtgctcgatttagtgctatagacttgggtttgggatgctttctgagagtcaagacctcctgtgcaagaacatgaagcacctgtggtttttcctcctgctggtggcagctccagatgggtcctgtcccaggtgcagctgcaggagtcgggccaggactggtgaggccttcgggaaccctgtctctcatctgcactgtctctgagtttcatcagttcttgatcattcttgggctggatccggcagccccaggagggaatggagtggatggtgacatccattatactggggcgacgtactactctccgtccctcaagagtcgtctcaccatttcgagggacacgtccatgaaaccgcttctccctgaaactgacctccgtgaccgccgcggacacggccgtttatttctgtgcgaggcgagactggtctttcaatctatgggccgtggcaccctggtcactgtctcctcagcttcaccaagggccatcggtcttcccctggcgccctgccagagcacctctgggcacagcggccctggctgcctgtcaaggactacttcctatatactgtctgagcggctggcaaggcgcatag

SEQ ID NO: 790094 - DNA, 667 bp, Homo sapiens
  misc_feature: 6007.UNK.UNK.UNK.pb.heavy.1.raw 6007
ctatgcgccttgccagcccgctcagacagtatataggaagtagtccttgacaggcagcccagggccgctgtgcccccagaggtgctcctggagcagggcgcccaggggaagacgatgggcccttggtggaagctgaggagacagtgaccagggtgccacggccccatagattgaaagaccagtctccgcctcgcaaagaaataaacggccgtgtccgcggcggtcacggaggtcagtttcagggagaagcggttccatggacgtgtccctcgaaatggtgagacgaactcttgagggacggagagtagtacgtcgcccagtataaatggaatgtcaccaatccactccattcccctccctggggggctgccggatccagcccagaatgatcagaactgatggaaactccagagacagtgcagatgagagacagggttcccgaaaggctcaccagtccctgggcccgactcctgcaagctgcacctgggacaggacccatctgggagctgccaccagcaggaggaaaaaaccacaggtgcttcaatgttcttgcacaaggagggtccttgactctcagaaaagcatccccaaacccaagtctatattacgcactaaatcgagcaccggtcgtgtatatactgtctgatggcgcgagggaggcgatacg

SEQ ID NO: 790095 - DNA, 717 bp, Homo sapiens
  misc_feature: 6011.UNK.UNK.UNK.pb.heavy.1.raw 6011
cgtatcgcctccctcgcgcccatcagtctatactatcacgaccggtgctcgatttagacgcgattcgaagggttttggggcctgggagacgagcccagcactggaagtcgccggtgtttccactcggtgatcatcactgaacacagaggactcaccatggagtttgggcctgagctgggttttcctcgttgcccctcttaagaggtgtcatagtgtcaggtgcaattcgtggagatctgggggaggcgtggcccagtaggggggtccctgagactctcctgtgcagcctctggattccaccttcgataattggaatatgcagtggtccgccaggctccaggcgaaggggctggagtgggtggccaggtgtgtcatttcatggaggaaatcaagtctacggtgattccgttgagggccgattcaccatctccagagacaattcgagaacacagtgtctcttcaaaatgaacagcctgagacgcctcaggacacggccgtcgtatttttgtgcggagactatctgtttccaaaatcggttcattcgacgcctgggccagggaaccctggtcacgcgtctcctcgggcctccaccaagggcccatcggtcttcccctggccgcctgctccaggagcacctccgagagcacagcggccctggctgcctggtcaaggactacttcctatatactcgtctgagcgggctggcaggcgccatag

SEQ ID NO: 790096 - DNA, 664 bp, Homo sapiens
  misc_feature: 6031.44.86.H09.1.pb.heavy.1.raw 6031
cgtatcgccttcctcgcgccatcagacagtatatacacgaccggtgctcgatttagtgctatagacttgggtttggggatgcctttctgagagtcaaggacctcctgtgcagaacatgaagcacctgtggttttttcctcctgctggtggcagctccccagatgggtcctgtcccaggtgcagctgcaggagtcgggcccagactggtgaggccttcgggaacccctgtctctcaatctgcactggtctctggagtttccatcagttctgatcattcttggggctggatccggcagcccccagggaggggaatggagtggattggtgacatccattatactggggcgacgtactacttctccgtccctcaagagtcgtctcaccattttcgagggacacgtccatgaaccgcttctcccctgaaactgacctccgtgaccgccgcggacacggccgtttatttctgtgcgaggcgagactggtctttcaatctatggggccgtgggcaccctggtcactgtctccttcagcttccaccaaggcccatcggtcttccccctggcgccctgctccaggagcacctctgggggcacagcggccctgggctgcctggtcaaggactacttcctatatactggtctgagcgggctggcaaggcgcatag

SEQ ID NO: 790097 - DNA, 715 bp, Homo sapiens
  misc_feature: 6041.44.36.D03.1.pb.heavy.1.raw 6041
cgtatcgcctccctcgcgccatcagacagtatatacacgaccggtgctcgatttagctgcgtcacgatctctcttgggagctctcagagaggtgccttagccctggattccaaggcatttccacttggtgatcagcaatgaacacagaggactcaccatggagttgggggctgcgctgggttttccttgttgctatttagaaggtgtccactgtgaggtgcggctggtggagtctgggggaggcttggtacagcggggggggtccctggagacttctcctgtgcagcctctggattcatcttcagtgactatgccatgaactgggtccgccaggctccagggaagggggctggaagtgggtttcatatgttaatattgctggagataccacctactacgcagactctgtgaagggccgattcaccaattccagggacaatgccaagactcactgtatcggaaatgaacagcctgagagacgaggacacggctgtctacttctgttcgagagatcgggccacttggtcagtggctggttttgactactggggccggggaaccctggtcaccgtctcctcagcctccaccaagggcccatcggtcttccccctggcgccctgctccaggagcacctccgagagcacagcggccctgggctgcctggtcaaggactacttcctatatactgtctgagcggggctggcaaggcgcatag

SEQ ID NO: 790098 - DNA, 689 bp, Homo sapiens
  misc_feature: 6050.44.36.D03.1.pb.heavy.1.raw 6050
ctatgcgcctgccagcccgctcagacagtattaggaagtagtccttgacaggcagcccagggcgctgtgctctcggaggtgctcctggagcagggcgccagggaagaccgatggcccttggtggaggctgaggatgacggtgaccagggttccctggcccagtggacagttcctgatataacacacacaataatacatgccgtgtcctcggttttcaggttagtcattcgcagaatcaatgagtcttgaagtcatctcttgagagggtgaatctgctttcacagacgcggcgtactctgtgataagctggcaacttgtttttactgcggccagccactccagccccttccctggagcctggcggaaccagagtccatatagtggtcactgatggtgaatccagaggcgacacagagagtctcagggaccctccaggctggaccaagtctccccggactccaccaactgcacttcactctggacactttgtaaaataacaacaaggaaaacccagctcagccgaactccatggtgagtcctctgtgttcagtgctgatcaccaaatgaaaacacctgggaattctgggctggggctccgctctcagagctccccaagagagatcgtgacgcagctaaatcgagcaccggtcgtgtatatactgtctgatggcgcggagggaggcgatacg

SEQ ID NO: 790099 - DNA, 706 bp, Homo sapiens
  misc_feature: 6052.44.55.E11.1.pb.heavy.1.raw 6052
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagccagaggctgcacaggagagtctctgggacccccccaggctggactaagcctcctccagactccatcagccgcacctcacactggacaccttttaaaagtccaacaaggagaacccagctcagccaaaactccatggtgagtctctgtgttcagtgctgatcaccgaatggaaacacctcggaatccccagtgctgggctcctctcccccccaaacccaacgtgcgagtgctaaatcgagcaccggtcgtgtatatactgtctgatggcgcgagggaggcgatacg

SEQ ID NO: 790100 - DNA, 616 bp, Homo sapiens
  misc_feature: 6062.UNK.UNK.UNK.pb.heavy.1.raw 6062
cccgacacgcttgctagggacttggagctaaggcgacgacatattgcctttagacagtcgaaggtgacgccttagctaccactgaacgtttaggcgccagatgcggtctgggatgacctaactcgcagcttatcgatgatctactgccacgctcaaccaaaccaggtcttgatgcgccgcgataggactgacgggatcgctacagacatttaactcgctagtaacttaattgagatcctaggggatgggataggaaatagaatccacccctatcacccgccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccaggtcacaggtaataaacaattcaacgtggcgtaaagattggccgctgctgtgggcattgcaagctgggtttgccagcattgtgcatgctagacgacaatatgaatctgcgggacccctagtggccaagatggccgctagcggggttccgcagcttttgacctggaccagggtgcatagcctgcccagccttc

SEQ ID NO: 790101 - DNA, 697 bp, Homo sapiens
  misc_feature: 6104.44.55.E11.1.pb.heavy.1.raw 6104
ctatgcgccttgccagcccgctcagacagtatataggagtagtccttgaccagggcagccagggccgctgtgccccagaggtgctcttggaggagggtgccagggggaagaccgatgggcccttggtggaggcggaggcgacggtgaccagggttccctggccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcgccctttcacggagtctgcgtagtatgtgaaatcaccagtataaatgactgagacccactccagcccttcctggagcctggcggaccaactcatgtagttgctgctgacggtgagcccagaggctgcacaggagagtctctgggacccccccaggctggactaagcctcctccagactccatcagccgcacctcacactggacaccttttaaaagtcaacaaggagaacccagctcagccaaaactccatggtgagtcctctgtgttcagtgctgatcacgaatggaaacacctcggaatccagtgctgggctcctctcccccccaaacccaacgtgcgagtgctaaatcgagcaccggtcgtgtatatactgtctgatggcgcgagggaggcgatacg

SEQ ID NO: 790102 - DNA, 603 bp, Homo sapiens
  misc_feature: 6186.UNK.UNK.UNK.pb.heavy.1.raw 6186
aggctgggcaggctatgcaccctggtccaggtcaaaagctgcggaacccgctagcggccatcttggccactaggggtcccgcagattcatattgtcgtctagccatgcacaatgctgcaaacccagcttgcaatgcccacagcaagcggccaatctttacgccacgttgattgtttatacctgtgactggctatggcttgcaacgccactcgtaaaactagtaactttgcggttaggggaagtagacaaacccattatccacttccggaagttcaactcattccaacacgaaataaaagtaaactcacaccccaaagcaggctatgtgggggggtgataggggtggattctattcctatcccatcccctaggatctcaattaagttactagcgagttaaatgtctgtagcgatcccgtcagtcctatcgcgcgcatcaagacctggtggttttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcagcgtgtcggg

SEQ ID NO: 790103 - DNA, 694 bp, Homo sapiens
  misc_feature: 6193.UNK.UNK.UNK.pb.heavy.1.raw 6193
cgtcatcgcctccctcgccgcatcagacagtatatacacgacccggtgctcgatttagtggaggtcagtaagggaaaggggctgggagagggagcccagcactagaagtcggccggtgtttccattcggtgatcagcactgaacacagaggactcaccatggagtttgggctgagctggggttttctcgttgctcttttaagagtgtccagtgttcaggttcagctggtggagtctgggggaggcgtggtcagcctgggacgtccctgagactctcctgtgttgcgtccggactcagtttcagtgactctgccattgcactgggttccgccaggctcccaggcaaggggctggagtggggtggcagtcattctggtctgatggaagtaaagaatactatggaaactccgtgaagggccgattctccgtctccagagacaattccaagaacaccggtgtatctacaaatgaacaatttgagagccgagactcggctctctattattgtacgagcccatcgttctactggggccagggagccctggtcaccgtctcctcagcctccaccaagggccatcggtcttccccctggcgccctgctccaggagcacctccgagagcacagcggccctgggctgccctggtcccaaggactacttcctattactgtctgagcggggctgcaaggcgcatag

SEQ ID NO: 790104 - DNA, 723 bp, Homo sapiens
  misc_feature: 6213.44.56.F01.1.pb.heavy.1.raw 6213
tctatgcgccttgccagcccgctcagacagtatataggaaagtagtcttgacaggcagcccagggccgctgtgccccagaggtggctcctggagcagggcgccaggggaagaccgatgggcccttggtggaagctgaagagacggtgaccattgtcccctggccccaaatatcaaatgcatcgacgtcccaggatcgcctggcgcagtaatagacgccctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagccccccccccgacctccgccagtcgcgccctcgcactggacacccttctaaaaaaactacaaggaaaaatcaagattagccccaaactccatgggttggtggtctgtgcctcagtgctgatcaccaagtggaaactcctgggaatctcacggctggggctcctctcccagagctcccctttgtgtgttcagacgtctgctaaatcgagcaccggtcgtgtatatactgtctgatggcgcgagggaggcgatacg

SEQ ID NO: 790105 - DNA, 685 bp, Homo sapiens
  misc_feature: 6256.UNK.UNK.UNK.pb.heavy.1.raw 6256
ctatgcgccttgccagcccgctcagacagtatataggaagtagtccttgaccaggcagccagggcgctgtgccccagaggtgctcttggaggagggtgccaggggaagaccgatgggcccttggtgaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtcctggagatggtgaatcggcccttcacggagtctgcgtagtatgtgaaatcaccagtataaatgactgagacccactccagcccttccctggagcctggcgaccaactcatgtagttgctgctgacggtgagccaggctgcacaggagagtctcggacccccaggctggactaagcctcctccagactccatcagccgcacctcacactggacaccttttaaagtccaacaaggagaacccagctcagccaaaactccatggtgagtcctctgtgttcagtgctgatcaccgaatggaaacatcggaatccagtgctgggctcctctcccccccaacccaatatgtatacgtctaaatcgagcaccgtcgtgtatatactgtctgatggcgcgaggaggcgatacg

SEQ ID NO: 790106 - DNA, 706 bp, Homo sapiens
  misc_feature: 6278.44.27.C05.1.pb.heavy.1.raw 6278
ctatgcgccttgccagcccgctcagatagtatataggaagtagtccttgaccaggcagcccagggccgctgtgctctcggaggtggctcctggagcagggcgccaggggaagaccgatgggcccttggtggagggccgaggagacggtgaccagggttccctggccccaggcgtcgaatgaaccgattttggaaacagatagtctcgcacaacaaatacacggccgtgtcctgaggtctcaggctgttcatttgaagagacactgtgttctcggaattgtctctggagatggtgaatcggccctcaacggaatcaccgtagacttgatttcctccatgaaatgacaccacctgccacccactccagcccctcgcctggagcctggcggacccactgcatattccaattatcgaaggtgaatccagaggctgcacaggagagtctcagggacccccctactggggccacgcctccccagactccacgaattgcacctgacacatgacacctcttaagagggcaacgaggaaaacccagctcagcccaaactccatggtgaagtcctctgtgttcagtgatgatcacggagtggaaacaccggcgacttccagtgctgggctcgtctcccagcccaaacccttcgatcgcgtctaaatcgagcaccggtcgtgtatatactgtctgatggcgcgagggaggcgatacg

SEQ ID NO: 790107 - DNA, 609 bp, Homo sapiens
  misc_feature: 6297.UNK.UNK.UNK.pb.heavy.1.raw 6297
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctagggatgggataggaaatagaaatccacccctatcacccccccacatagcctgcttggggtgttgagtttacttttatttcgtgttggaatgagttgaacttccggaagtggagtaatgggtttgtctacttccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagaccgacaatatgaatctgcgggacccctagtggcccaagatggcccgctagcgggttccgcagcttttgacctgaaaccaggtgcatagcctgcccagccttc

SEQ ID NO: 790108 - DNA, 604 bp, Homo sapiens
  misc_feature: 6308.UNK.UNK.UNK.pb.heavy.1.raw 6308
gaaggctgggcaggctatgcaccctggtccaggtcaaaagctgcggaacccgctagcggccatcttggccactagggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacacccaagcaggctatgtgggggggtgataggggtggattctatttcctatcccatcccctaggatctcaattaagttactagcgagttaaatgtctgtagcgatcccgtcagtctatcgcgcgcatcaagacctggttggttgagcgtgcagtagatcatcgataagctgcgagttaggtcatcccagacgcatctggcgcctaaacgttcagtggtagctaaggcgtcaccttcgactgtctaaaggcaatatgtcgtccttagctccaagtccctagcaagcgtgtcggg

SEQ ID NO: 790109 - DNA, 703 bp, Homo sapiens
  misc_feature: 6311.44.73.G07.1.pb.heavy.1.raw 6311
ctatgcgccttgccagccgctcagacaggtatataggaagtagtccttgaccaggcagccagggccgctgtggctctcggaggtgctcctggagcaggcgccaggggaagaccgatgggcccctggtggagcttgaggagacggtgaccagtgtcccctggcccagtgaaacgcccgataatagctgctgccacttcccgatctcgcacagtaatacagagccgagtcctcgcctcttcaggctgatcatttccaggtacagagtgttccgggaattgtctctggagatggtgaatcggcccttcacggagtctgcataatatctagaagttccatcatatgctataacttgccaaccactccgccccttgcctggagcctggcggacccagtgcatgccagaactactgaactaaatccagaggcttcacaggagagtctcagggacctccccaggctggaccacgcctccccagactccaccaaggtgcacctgacactggacacctcttaaaagagtaacgagaaaacccagctcagcccaaactccatggtgagtcctctgtgttcagtgctgatcaccgaatggaaaccaccgccgacttctagtgctgggctcctctcccagagctccctgagcgtagagctaaatcgagcaccggtcgtgtatatactgtcctgatggcgcgagggaggcgatacg

SEQ ID NO: 790110 - DNA, 584 bp, Homo sapiens
  misc_feature: 6344.44.78.H01.1.pb.heavy.1.raw 6344
ctatgcgccttgccagcccgctcagacagtatataggaagtagtccttgaccaggcagcccagggccgctgtgctctcggaggtgctcctggagcagggcgccagggggaagaccgatgggccttggtggaggctgaggagacggtgaccagggttccctggccccacaagtcaagccaggtgctgtggctctcgcacagaaatacacggcgtgtcctcagatctcaggctgctcagttccatgtagactgtacctggggaggtgctcctggtcatactaactctgccttggaacttctgggcaaagcccgtgttgccactatagggcttcatccatcccatccactccagccttgtccagcggcctgtcgcacccagttaatatcataattgatgaacgtgtatccagaagccgtgcaggagactgtcactgaggcccaggcttcttcacctcagccccagactgcaccagctgtacctggagtgggaccgtcagtcttcctcttcccccaaaccaaactactcacactaaatcgagcaccggtcgtgtatatactgtctgatggcgcgagggaggcgatacg

SEQ ID NO: 790111 - DNA, 693 bp, Homo sapiens
  misc_feature: 6347.44.36.D03.1.pb.heavy.1.raw 6347
ctatgcgccttgccaggcccgctcagacagtatatagaagtcagtccttgaccaggcagcccagggcgctgtgctctcggaggtgctcctggagcagggcgccaggggaagaccgatgggcccttggtggaggctgaggagacggtgaccagggttccctggccccagtggacagttcctgatataaacacaacacaataatacatgccgtgtcctcggtttcaggttagtcattcgcagaatcaatggagttcttgaagtcatctcttgagagggtgatctggctttcacagacgcggcgtacctgtgataagctggcaactttgttttactgcggccaagccactccagcccttcccggagcctggcggaccagtccatataggtggtcactgatggtggaatccagaggcgacacaggagagtctcagggaccctccaggctggaccaagtctccggactccacaactgcacttcactctggacaccttgtaaaataacaacaaggaaaacccagctcagcccgaactccatggtgagtcctctgtgttcagtgctgatcaccaaatgaaaacacctgggaattctgggctggggctccgccttcagagctccccaagagagatcgtgacgcagctaaatcgagcaccggtcgtgtatatactgtctgatggcgcgagggaggcgatacg

SEQ ID NO: 790112 - DNA, 648 bp, Homo sapiens
  misc_feature: 6351.44.53.E09.1.pb.heavy.1.raw 6351
gtatcgcccctccctcgcgccatcagacagtatatacacgaccggtgctcgatttagagagagtgtgttggttgggggggaagcacctgtggttcttcctcctgctggtggcgctcccagatgggtcctgtctcagccgcagctgcggagtcgggcccaggactggtgaagccttcggagaccctgtccctcacgtgcacggtctctggtgccccatcgacagaagtaatttctactggggctggatcgccccagccccaggagagggctgcagtggattgggagtctctattatagtgggaacacctactacaacccgtccctcaacggtcgagtcaccatatccgtggacacgtcgaggacacagttttccctgaagtgagttctgtggccgccgccgacacggcctgtctactactgtgtcagacatgggtccgcctatggcaggtcgtctcaattctactacgcttggacgtctgggggccaagggacacggtcaccgtctcctcatcctcagctccaccaagggccatcggtcttcccctggcgccctgctccaggagcacctccgagagcacagcggccctgggctgcctggtcaggactacttcctatatactgtctgagcggggctggcaaggcgcatag

SEQ ID NO: 790113 - DNA, 715 bp, Homo sapiens
  misc_feature: 6436.44.56.F01.1.pb.heavy.1.raw 6436
ctatgcgccttgccagcccgctcagacagtatataggaagtagtccttgaccaggcagcccagggccgctgtgcccccagaggtgctcctggagcagggcgccagggggaagaccgatgggcccttggtggaagctgaagagacggtgaccattgtcccctggccccaaatatcaaaatgcatcgacgtcccaggatcgcctggcgcagtaatagacgctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagaagaccgccctgctgtgccaagcccccccccgactccgccagtcgcccctcgcactggacaccttctaaaaaaactacaaggaaaatcaagattaagcccaaactccatggttggtggtctgtgctcagtgctgatcaccaagtggaaactcctgggaatctcacggctgggctcctctcccagagctcccctttgtgtgttcagacgtctgctaaatcgagcaccggtcgtgtatatactgtctgatggcgcgagggaggcgatacg

SEQ ID NO: 790114 - DNA, 663 bp, Homo sapiens
  misc_feature: 6461.UNK.UNK.UNK.pb.heavy.1.raw 6461
ctatgcgccttgccagcccgctcagacagtatataggaagtagtccttgaccaggcagcccagggccgctgtggccccagaggtgctcttggaggagggtgccaggggaagaccgatgggcccttggtggaggctgaggagacggtgacccagggttccctggccccagtggtcaaagtagttggtgacgaactgccctactctcgcacagtaatacacggccgtgtccgcggcggtcacagagctcagcttcagggagaactggttcttggacgtgtcctactgatatggtgactcgactcttgagggacggttgtagtaggtgctcccactataatagatactcccaatccatccagccccttcctgggggctggcggatccagccccccagtagtactactactgctgatggagccaccagagacagtgcaggtgagggacagggtctccgaaggcttcaccagtcctgggcccgactcctgcagctgcagctgggacaggaacccatctggagccgccaccagcaggaggaagaaccacaggtgcttcatgttcttgcacaggaggtccatgactctcagaaagccccgcggaatctacactactaaatcgagcacccggtcgtgtatatactgtctgatggcgcgaggaggcgatacg

SEQ ID NO: 790115 - DNA, 651 bp, Homo sapiens
  misc_feature: 6484.44.86.H09.1.pb.heavy.1.raw 6484
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaatggtgagacgactcttgagggacggagagtagtacgtcgccccagtataatggatgtcaccaatccactccattcccctccctggggctgccggatccagccccagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggccgagggaggcgatacg

SEQ ID NO: 790116 - DNA, 710 bp, Homo sapiens
  misc_feature: 6489.UNK.UNK.UNK.pb.heavy.1.raw 6489
cgtatcgcctccctcgcgccatcagacagtatatacacgaccggtgctccgatttagctgcgtccacgatctctcttgggggagagcggagccccagccccagaatttccagggttttcattggtgatcagcactgaacacagaggactcaccatggagttcgggctgagctgggttttccttgttgttattttacaaggtgtccagagtgaagtgcagttgggtggagtccgggggagacttggtccagcctggagggtccctgagactctcctgtgtcgcctctggattcaccatcagtgaccactatatgactggtctccgccaggctccagggaagggggctggaggtggcttggccgcagttaaaaacaaagttgccagctttatcacagagtacgccgcgtctgtgaaagccagattcaccctctcaagaagatgacttcaagaactcattgattctgcgaatgactaacctgaaaaccgaggacacgggcatgtattattgtgttgtgtttatatcaggaactgtccactggggccagggaaccctggtcaccggtctcctcagcctccaccaagggcccatcggttcttccccccttggcgccctgctccaggagcacctccgagagcacagcgggccctgggctgcctggtcaaggactacttcctatattactgtctgagcgggctggcaaggcgcatag

SEQ ID NO: 790117 - DNA, 703 bp, Homo sapiens
  misc_feature: 6497.44.27.C05.1.pb.heavy.1.raw 6497
cgtatcgcctccctcgcgccatcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctggggaggcgtggcccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcgcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790118 - DNA, 705 bp, Homo sapiens
  misc_feature: 6524.44.62.F07.1.pb.heavy.1.raw 6524
ctatgcgccttgccagcccgctcagacagtatataggaagtagtccttgaccaggcagcccagggccgctgtgctctcggaggtgctcctggagcagggcgccagggggaagaccgatgggcccttggtggaggctgaagagacggtcaccactgtccccggccccaagtactaaaggtgtcatgggggtcaccgtggtcctggctttcaaacagtaatagacgcctgtgtcctcgggtctcaggtttttcatttggagaaacaattgtcctgcgaattgtccctggaaatggtgaagcggcccttcacggagtctccgtagaaagtgacaccaccagctccgatacttgagacccactccagtcccctccctggagcccggcggacccaggtcatgccatagcactaaaggtgaatccagaggccgcacaggagagggtcagggacctcccaggccgaatcaggccccccccagactcaacaactgcacttcacacacgacaccctttaaaaaagccacaagaaaaaggcagctcagcccaaactcccatggagacttctctctgttcggtcctggtcaccaaatgaagacacctgaaaatcccagggctgggctcctctctcagagctcccctttccctttatgcgactactaaatcgagcaccggtcgtgtatatactgtctgatggcgcgagggaggcgat

SEQ ID NO: 790119 - DNA, 700 bp, Homo sapiens
  misc_feature: 6527.44.62.F07.1.pb.heavy.1.raw 6527
cttgccagcccgctcagacagtatataggaagtagtccttgaccaggcagcccagggccgctgtgctctcggaggtgctcctggagcaggcgccaggggaagaccgatgggcccttggtggaggctgaagagacggtcaccactgtcccccggccccaagtactaaaggtgtcatgggggtcaccgtggtcctggctttcaaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagacccactccagtcccctccctggagcccggcggacccaggtcatgccataggcactaaaggtgaatccagaggccgcacaggagagggtcagggacctcccaggccgaatcaggccccccccccagactccaacaactgcacttcacacacgacaccctttaaaaaagccacagaaaaaggcagctcagcccaaactccatggagacttctctctgttcggtcctggtcaccaaatgaagacacctgaaaatcccaggctgggctcctctctcagagctcccctttccctttatgcgactactaaatcgagcaccggtcgtgtatatactgtctgatggcgcgaggaggcgatacg

SEQ ID NO: 790120 - DNA, 727 bp, Homo sapiens
  misc_feature: 6535.UNK.UNK.UNK.pb.heavy.1.raw 6535
cgtatcgcctccctcgccggccaatcagcagtatataccacgaccggtgctcgatttagctgcggtcacgatttcttctttgggcgagctctgagagcggaggcccagccccagaattcccaggtgttttcatttggtgatcagcactgaacaccgaggactcaccatggagttcggcgctgagctggggttttccttgttgttatttttacaaggtgtccagagtgaagttgccagttggtggagtccgggggggagacttggtccagcctggagggctccctgagacttccctgtgttcgcctctggattcaccatcagctgaccactatatggactgggtccgccaggctccaggggaagggcctggagtggcttggccgcagtaaaaacaagttggccagctttatcacagagtacgccgcgtctgtgaaagccagattcaccctctcaagagatgactttcaagaactcattgattctgcgaatgactaacctgaaaacgaggacacgggcatcgtattattgtgttgtgtttatatcaggaactgtccactggggccagggaaccctggtcaccggtctcctcaggccccaaagggcccatcggtcttcccctggcgccctgctccaggagcacctccgagagcacagcggccctgggctgcctggtcaaggactacttcctaatcatactgtctgagcggcctgggcaaggccgccatag

SEQ ID NO: 790121 - DNA, 580 bp, Homo sapiens
  misc_feature: 6569.UNK.UNK.UNK.pb.heavy.1.raw 6569
ccgacacgcttgctaggacttgagctaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacggatcgctacagaccatttaactcgctagtaacttatgagatctagggatggataggaaagaatccaccctatcacccccacatagcctgctgggtgttgagtttacttttatttcgtgttggaatgagttgaacttcggaagtggagtaatggtttgtctacttcccctaccgcaaagtactagttttacgagtggcgttgcaagccatagcagtcacagtaataaacaattcaacgtggcgtaaagattggccgcttgctgtggcattgcagctgggttgcagcattgtgcatgctagacgacaatatgaatctgcggacccctagtgccaagatgccgctagcgggttccgcagcttttgacctggaccagggtgcatagcctgcccagccttc

SEQ ID NO: 790122 - DNA, 709 bp, Homo sapiens
  misc_feature: 6577.UNK.UNK.UNK.pb.heavy.1.raw 6577
ctatgcgccttgccagcccgctccagacagtatataggaagtagtcctgaccaggcagcccagggccgctgtgctctcgaggtgctctggagcaggggcgccagggggaagaccgatgggcccttggtggaggctgaggagacggtgaccagggtttccctggccccagtgacagttcctgatataaacacaacacaatataatacatgcccgtgtccttcggttttcaggttagtcattcgcagaatcaatgagttcttgaaaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatcagaggcgacacaggagagtctcagggaccctccaggctggaccaagtctcccccggactccaccaactgcacttcactctggacaccttgtaaaataacaacaggaaaacccagctcagcccgaactccatggtgagtcctctgtgttcagtgctgatcaccaatgaaaacacctgggaattctggggctgggctccgctctcagagctcccccaaggagagatcgtgacgccagcttaatcgagcaccggtcgtgtatatactgtctgatggcgcgaagggaggcgatacg

SEQ ID NO: 790123 - DNA, 657 bp, Homo sapiens
  misc_feature: 6589.44.23.C01.1.pb.heavy.1.raw 6589
cgtatcgcctcctcgcgcgccatcagacagggtatatacacgaccggtgctcgatttagtacacgtgattagggattgggggctttctgagagtcaaggaccctcctgtgcaagaacatgaagcacctgtgttttttcctcctgctggtggcagctcccagatgggtccctgtcccaggtgcagctgcagagtcgggcccagactgcgtgacggccttcgggaaccctgtctctcatctgcactgtctctggagtttccatcagttctgatcattcttggggcgctggatccgcagccccagggagggaatggagtggattggtgacatccattatactggcggcgacgtgctactctccgtccctcaagagtcgtctcaccatttcgaggacacgtccatgaaccgcttctcccctgaaactgacctccgtgaccgccgcggacacggccgtttatttctgtgcgaggcgagactggtctttcaatctatggggccgtggcaccctggtcacctgtctcctcagcttccaccaaggcccatcggtcttcccctggcgccctgctccaggagcacctctgggggcacagcgccctgggctgcctggtcaaggactacttcctatatactgtctgagcgggctggccaaggcgcatag

SEQ ID NO: 790124 - DNA, 659 bp, Homo sapiens
  misc_feature: 6622.44.53.E09.1.pb.heavy.1.raw 6622
cgtatcgcctccctcgcgccatcagacagtatatacacgaccggtgctcgattttagagagagtgtgtttgggtttggggggaagcacctgtggtttcttcctcctgctggtggcggctcccagatgggtcctgtctcagccgcagctgcgggagtcgggccaggactggtgaagccttcggagaccctgtccctcacgtgcacggtctctggtgcctccatcgacagaagtaatttctactggggctggattccgccagcccccaggagaggggctgcagtggattgggagtctctattatagtggggaacacctactacaacccgtccctcaacggtcgagtcaccatatccgtggacacgtcgaggacacagttttccctgaagtgagttctgtggccgccgccgacacggctgtctactactgtgtcagacatgggtccgcctatggcaggtcgtctcaattctactacgcttgggacgtctggggccaagggaccacggtcacccgtctcctcatcctcagcctccaccaagggcccatcggtcttccccctggcgccctgctccaggagcacctccgagagcacagcggccctggctgcctggtcaaggactacttcctatatactgtctgagcgggctggcaaggcgcatag

SEQ ID NO: 790125 - DNA, 709 bp, Homo sapiens
  misc_feature: 6626.44.36.D03.1.pb.heavy.1.raw 6626
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccccggccccagtagtcaaaccagccactgaccagtggcccgatctctcgaacagaagtagacagccgtgtcctcgtctctcaggctgttcatttccagatacagtgagttctggcattgtccctggaattggtgaatcggcccttcacagagtctgcgtagtaggtggtatctccagcaatattaacatatgaaacccactccagccccttccctggagcctgcggacccagttcatggcatagtcactgaagatgaatccagaggcctgcacaggagagtctcagggacccccccccgctgtaccaagcctcccccagactccaccagccgcacctcacagtggacaccttctaaaatagcaacaaggaaaaccagcgcagccccaactccatggtgagtcctctgtgttccagtgctgatcaccaagtggaaatgccttggaatccagggctaaggcacctctctgagagctcccaagagagatcgtgacgcagctaaatcgagcaccggtcgtgtatatactgtctgatggcgcgagggaggcgatacg

SEQ ID NO: 790126 - DNA, 683 bp, Homo sapiens
  misc_feature: 6665.44.74.G08.1.pb.heavy.1.raw 6665
cgtatcgcctccctcgcgccatcagacagtatatacacgaccggtgctcgatttagtagctctatcagggggagcatcacataacaaccacattcctcctctaaagaagcccctgggagcacagctcatcaccatgactggacctggaggttcctctttgtggtggcagcagcaacaggtgtccagtccctggtgcaactggtgcagtctgggactagaatgccgcaaccttgtcctcggtgaccctttcctgcacggcctctggaagtactaccagttccactacttataccatcaactgggtgcgccaggcccctggacaagggcttgagtggatggtggaatcatccctctttttggctcactcacctacgcacgagacttccgggcagaattacgattacgcggacaagtccacagacacagtctccatgacaatgagttctttgaatccgacgacacggccgtctactactgtgcgagaggtccgtaccccagctcgcatggagcctttgagatctggggcagggaaccctggtcattgtcacctcagcttccaccaagggcccatcggtcttcccctggcgccctgctcaggagcacctctgggggcacagcggccctggctgcctgtcaaggactacttcctatatactgtctgagcgggctggcaaggcgcatag

SEQ ID NO: 790127 - DNA, 701 bp, Homo sapiens
  misc_feature: 6692.UNK.UNK.UNK.pb.heavy.1.raw 6692
ctatgcgccttgccagcccgctcagaacagtatataggaagtagtccttgaccaggcagcccagggccgctgtgctctcggaggtgctcctgagcaggcgccaggggaagaccgatgggcccttggtggaggctgaggagacggtgaccagggtcctggccccagtcatgcggcccggtaataactactaccacgccccgatctcgcacagtaatacagagccgagtcctcgactctcaggcctgaccatttccaagtacacaatgttccgggaattgtctctggagatggtgaatcggcccttcacggagtctgcataatattcagaacttccatcatgtgctataactgccaaccactccggccccttggcctggagcctggccggacccagtgcatgccagaaccactgaaactaaatccagaggctttcacaggagagtctcagggacctcccaggctgaccacgcctcccagactccaccaggtgcacctgacagtggacacctcttaaaaaagcaacgaggaaacccagctcagcccaaactccatggtgagtcctctgtgttcagtgctgatcaccgaatggaacaccgccgactctatgctgggctcctctcccagacccctttccttcacactacactaaatcgagcacggtcgtggtatatactgtctgatgcgcgaggaggggcgatacg

SEQ ID NO: 790128 - DNA, 611 bp, Homo sapiens
  misc_feature: 6693.UNK.UNK.UNK.pb.heavy.1.raw 6693
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcaccccccacatagcctgcttggggtgttgagtttacttttatttcgtgttggaatgagttgaacttccgggaagtggagtaatgggtttgtctacttccccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagaacgacaatatgaatctgcgggacccctagtggccaagatggccgctagcgggttccgcagcttttgacctgggaccaggggtgcatagcctgcccagccttc

SEQ ID NO: 790129 - DNA, 682 bp, Homo sapiens
  misc_feature: 6711.UNK.UNK.UNK.pb.heavy.1.raw 6711
cgtatcgcctccctcgcgcccatcagacagtatatacacgaccggtgctcgatttatgctatagacttgggtttggggatgctttctgagagtcaaggaccctcctgtgcaagaacatgaagcacctgtggtttttcctcctgctggtggcagctcccagatgggtcctgtcccaggtgcagcctgcaggagtcgggcccaggactggtgaggcggccttcggggaaccctgtctctcatctgcactgtctctggagtttccatcagttctgatcattcttggggctggatccggcagccgccccagggaggggaatggagtggattggtgacatccattatactggggcgacgtaactactctccgtccctcaagagtcgtctcaccatttcgagggaacacggtccatgaaccgcttctccctgaaaactgacctccgtgaccgccgcggacacggcggccgggccgcttcattttctgtgcgaggcgaggactggtctgttcaatctatggggcccgtgcacgccctggtcactgtctcctcagcttccaccaagggcccatcgtcttccccctggcgccctgctccaggagcacctctggggcacagcggccctgggctgcctgggtcaagggactacttcctatataactgtctgagcgggctggcaaggcgcatag

SEQ ID NO: 790130 - DNA, 608 bp, Homo sapiens
  misc_feature: 6738.UNK.UNK.UNK.pb.heavy.1.raw 6738
ccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccaccctatcacccccccacatagcctgcttggggtgttgagtttacttttatttcgtgttggaatgagttgaacttccgggaagtggagtaatgggtttgtctacttcccctaaccgcaaagtactagttttacgagtggcggttgcaagccatagccagtcacaggtaataaacaattcaacgtggcgtaaagattggccgcttgctgtgggcattgcaagctgggtttgcagcattgtgcatggctagacgacaatatgaatctgcgggacccctagtggccaagatgggccgctagcgggtccgcagcttttgacctggaccagggtgcatagcctgcccagccttc

SEQ ID NO: 790131 - DNA, 612 bp, Homo sapiens
  misc_feature: 6756.UNK.UNK.UNK.pb.heavy.1.raw 6756
cccgacacgcttgctagggactttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatggcgcgcgataggactgacgggatcgctacagacatttaactcgctagtaacttaattgagatcctaggggatgggataggaaatagaatccacccctatcacccccccacatagcctgcttggggtgttgagtttacttttattcgtgttggaatgagttgaacttccgggaagtggagtaatgggtttgtctacttcccctaaccgcaaaagtactagttttacgagtggcgttgcaagccatagcagtcacaggtaataaacaattcaacgtggccgtaagattggccgcttgctgtggcattgcaaggctgggttttgcagcattgtgcatgctagacgacaatatgaatctgcgggaccgccctagtggcccaaggatggccgctagcgggttccgcagcttttgacctggaccagggtgcatagcctgcccagcct

SEQ ID NO: 790132 - DNA, 690 bp, Homo sapiens
  misc_feature: 6762.44.27.C05.1.pb.heavy.1.raw 6762
ctatgcgccttgccagccgctcagacagtatataggaagtagtccttgaccaggcagcccagggccgctgtgctctcgaggtgctctggagcaggcgccagggggaagaccgatggccctggtgaggccgaggagacggtgaccagggttccctggccccaggcgtcgaatgaaccgattttggaaacagatagtctcgcacaaaaatacacggccgtgtcctgaggtctcaggctgttcattgaagagacactgtgttctcggaattgtctctggagatggtgaatcggccctcaacggaatcaccgtagacttgatttcctccatgaaatgacacacctgccacccactcagcccctcgcctggagcctggcggaccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagccaaactccatggtgagtcctctgtgttcagtgatgatcacgagtggaaacaccggcgacttccagtgctgggctcgtctcccagcccaaacccttcgatcgcgtctaaatcgagcaccggtcgtgtatatactgtctgatggcgcgaggaggcgatacg

SEQ ID NO: 790133 - DNA, 688 bp, Homo sapiens
  misc_feature: 6767.UNK.UNK.UNK.pb.heavy.1.raw 6767
cgtatcgcctccctccgcgccatcagacagtatatacacgaccggtgctcgattttgatcacataacaaccacactcctcctctaaagaagccctgggagcacagctcatcaccatggactggacctggcggttcctcttgtggtggcagcagctacaggtgtccagtcccaggtgcagctggtgcagtctggggctgaggtgaagaagcctggtcctcggtgaaggtctcctgcaaggcttctggagcaccttcttcagctatgcttttatttgggtgcgacaggcccctggacaagggcttgagtggctgggagggatcatccctatctttggtgcatcgaattacgcacagaagtttcaggacagagtcaccattacgcggacgaatccacgagtacagcctacatggagctgagcaggctgagatctgaagacacggccatctatttctgtgcgagagccctcgtcactttcatagtccctctcatagtccacacatggaaattggttcgacccctgggccagggaacctggtcaccgtccctcagcttcccaccaagggcccatcgtcttccccctggcgcccctgctccaggagcacctctggggcacagcggccctgggctgcctggttcaaggactacttccctatatactgtctgagcgggctggcaaaggcgcaatag

SEQ ID NO: 790134 - DNA, 709 bp, Homo sapiens
  misc_feature: 6797.44.36.D03.1.pb.heavy.1.raw 6797
cgtatcgcctccctcgcgccatcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtctggggaggcttggtacagcgggggggtccctgagactctcctgtgcagcctctggattcatcttcagtgactatgccatgaactgggtccgcaggctccagggaaggggctggagtgggtttcatatgttaatattgctggagataccacctactacgcagactctgtgaagggccgattcaccaattccagggacaatgccaagaactcactgtatctggaaatgaacagcctgagagacgaggacacggctgtctacttctgttcgagagatcgggccacttggtcagtggctggttttgactactggggccggggaaccctggtcaccgtctcctcagcctccaccaagggcccatcggtcttcccccctggcgccctgctccaggagcacctccgagagcacagcggccctgggctgcctggtcaagactacttcctatatactgtctgagcgggctggcaaggcgcatag

SEQ ID NO: 790135 - DNA, 572 bp, Homo sapiens
  misc_feature: 6826.44.78.H01.1.pb.heavy.1.raw 6826
cgtatcgcctccctcgcgccatcagtctatactatcacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 790136 - DNA, 719 bp, Homo sapiens
  misc_feature: 6847.44.85.H08.1.pb.heavy.1.raw 6847
ctatcgcgccttggcagcccgctcagacagtatataggaagtagtccttgaccaggcagcccagggccgctgtgcccccagaggtgctcttggaggagggtgccagggggaagaccgatgggcccttggtggaggctgaggagacggtgaccgtggtcccttggcccagacgtccataccgtagtagagtcccagcaggtggtagtactacaatatgtcctcgcacagtaatacacagccgtgtcctcggctctcaggctgttcatttgcagatacagcgtgttcttggaattgtctctggagatggtgaatcggcccttcacgggtctgcatgtatttattacttccatcataccatataagtgccacccactccagccccttgcctggagcctggcggacccagtgcatgccataggtactgaaggtgaatcagacgctgcacaggagagtctccagggacctcccaggctggaccacgcctccccagactccaccagctgcacctgacactgacacctcttaaaaaggcaacgaggaaaaacccagctcagcccaaactccatggtgagtcctctgtgttcagtgccgatcaccgaatggaaacaccgccgacttctagtgctgggctcctctcccagagctccccgcgactgagtgatactaaatcgagcaccggtcgtgtatatactgtctgatggcgcgagggaggcgatacg

SEQ ID NO: 790137 - DNA, 505 bp, Homo sapiens
  misc_feature: 6849.44.56.F01.1.pb.heavy.1.raw 6849
cgtatcgcctcctcgcgccatcagacagtatatacacgaccggtgctcgatttagcagacgtctgtcggggggcccctaagactctcctgtctcgtctctgaacccacctttagcagctactggatgcactgggtccgccaagctccaggaaagggcctgatggtgggtctcacgtattaacaccgatgggactatcactggttactcagacgccgtgaagggccgattcatcatctccagagacaatgtcgaaaacacggtgtatttacaaatgaacagtctaagagtcgaggacacggctgtctactattgtgtgagaccttatgatttcacttgggggggagttatcgtttgggcccacactgggggccagggaacctggtcgtcgtctcctcagcttccaccaagggcccatcggtcttccccctggcgccctgctccaggagcacctctgggggcacagcgggccctgggctgcctggtcaagggactacttccatatac

SEQ ID NO: 790138 - DNA, 700 bp, Homo sapiens
  misc_feature: 6863.UNK.UNK.UNK.pb.heavy.1.raw 6863
cgtatcgcctccctcgcgccatcagacagtatatacacgacggtgctcgatttagtgtagtgtgaaggaaaggggtcgggagaggagcccagcactagaagtcggcggtgtttccattcggtgatcagcactgaacacagaggaactcaccatggagtttgggctgagctgggttttcctcgttgctctttaagaggtgtccactgtcaggtgcacctgtggagtctggggaggcgtggtccagcctgggaggtccctgaggactctcctgtgaagcctctggatttagtttcagtggttctggcatgcactgggtccgccaggctccaggcaaggggccggagtggttggcagttatagcacatgatggaagttctgaatattatgcagactccgtgaagggccgattcaccatctccagagacaattcccggaaattgtgtacttggaaatggtcagcctgagagtcgaggactcggctctgtattactgtgcgagatcgggaggtggtagtagttattaccgggcgcatgactggggccagggaccctggtcaccgtctcctcagcctccaccaagggcccatcggtcttccccctggcgccctgctccaggagcacctccgagagcacagcggccctgggctgcctggtcaaggactacttcctatatactgtctgagcggctggcaagcgcatag

SEQ ID NO: 790139 - DNA, 710 bp, Homo sapiens
  misc_feature: 6903.UNK.UNK.UNK.pb.heavy.1.raw 6903
ctatgcgccttgccagcccgctcagacagtatataggaagtattccttgaccaggcagccagggccgctgtgctcctcggaggtgctcctggagcagggcgccagggggaagaccgatggccccttggtggaggccgaggagacggtgacccagggttccctggccccaggcgtcgaatgaaccgatttttggaaacagatagtctcgcacaaaaatacacggccgtgtcctgaggtctccaggctgttcatttgaagagacactgtgttctcgaattgtctctggagatggtgaatcggccctcaacggaatcaccgtagacttgatttgccctccatgaaatgaacacacctgccacccactccagcccctcgcctggagcctggcgggacccactgcatattccaattatcgaaggtgaatccagaggctgcaacaggagagtctcagggacccccctactggggcccacgccccctcccagactcacgaatgcacctgacacatgacacctcttaagagggcaacgaggaaaacccagctcagcccaaactccatggtgaagtcctcctgtgttcagtgatgatcaccgagtgggaaaacaccggacttccagtgctggcgtctcccaggcccaaacccttcgatcggcgtcctaaatcgagcacggtcgtgtatatactgtctgatggcgcgagggaggcgatag

SEQ ID NO: 790140 - DNA, 703 bp, Homo sapiens
  misc_feature: 6916.UNK.UNK.UNK.pb.heavy.1.raw 6916
cgtatcgcctcctcggccgcgccatccagacagtatatgccccgaccggtgctcgatttagtgtcgtcgcaagagagaggaggcccccagccgtgagattcccaggagtttccacttggtgatcagcactgagcacagacaccaaccatggagtttgggctaatcttgattttccttgtagtttttttagaaggtgtccagtgcgaggggcgactgcggagtcggggggggcttggcacagccagggcgcgtctctgagactctcctgtgtagtctcaggattcagtcttagtgattatcacttggcctgggtccgtcaggctccagggaaggggcttgagtggatcactttcgtcagaatgaaacgttatggtgaagtaaagagtacgccgcgtctgtgaagcggagattcaccgtctcaagggatgactccaacagtgttggccatttacaaatgagcaaccctgagaccgcgacgacacaggcgtctattactgcgccaggcgatcctgggacgtcgatgcatttgatatttggggccaggggacaatggtcaccgtctcttcagcttccacgaagggccgccatcgtctcttccccctggcgcctgctccaggagacctctgggggcacagcggcctggggctgcctggtcaaggactacttcctatatactgtctgagcgggctggcaaggcgcatag

SEQ ID NO: 790141 - DNA, 701 bp, Homo sapiens
  misc_feature: 6936.44.27.C05.1.pb.heavy.1.raw 6936
cgtatcgcctccctcgcgccatcagacagtatatacacgaccggtgctcgatttagacgcgatcgaaggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccaggaaccctggtcaccgtctcctcggcctccaccaagggcccatcggtcttccccctggcgccctgctccaggagcacctccgagagcacagcggcctgggctgcctggtcaaggactacttcctatatactgtctgagcgggctggcaaggcgcatag

SEQ ID NO: 790142 - DNA, 721 bp, Homo sapiens
  misc_feature: 6977.44.85.H08.1.pb.heavy.1.raw 6977
ctatgcgccttgccagcccgctcagacagtatataggaagtagtccttgaccaggcagcccagggccgctgtgcccccagaggtgctcttgaggagggtgccagggggaagaccgatgggccctggtggaggctgaggagacggtgaccgtggtcccttggcccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggacccacgcctccccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggctcctctccagagctccccgcgactgagtgatactaaatcgagcaccggtcgtgtatatactgtctgatggcgcgagggaggcgatacg

SEQ ID NO: 790143 - DNA, 689 bp, Homo sapiens
  misc_feature: 6984.44.67.G01.1.pb.heavy.1.raw 6984
cgtatcgcctccctcgcgcatcagacagtatatacacgaccggtgctcgatttagagtatacatattgggtttggggggagaggagcccagactggattccgaggtgttttccattcggggatcagcactgaacacagagactcaccatggagttttggctgagctgggttctccttgttggacttttaaaaggtgtcagtgtgaggtgcggctgatggagtctggaggaggcttagtccagcctggggggtcccagagactctcctgtgcagccctgggctcaccgtcagcagcaactacatgagttgggtccgccaggctccaggaaggggctggagtgggtctcagtcatttatactggtgatttcacatactacgcagactccgtgaaggccgattcaccatctccagggacaattcaggaacacggtttatcttcaaaatgaacaacctgagaggcgacgacacggccgtctattactgtgcgagaaagtcggcgctcggagtggttattatcgtttgacttctggggccagggaaccctggtcaccgtcgcctccgcctcaccaagggcccatcggtctttcccctggcaccccctccaagagcacctctgggggcacagcgccctgggctgcctggtcagactacttcctatatactgtctgagcggctgcaaggcgcatag

SEQ ID NO: 790144 - DNA, 681 bp, Homo sapiens
  misc_feature: 6986.44.27.C05.1.pb.heavy.1.raw 6986
cgtatcgcctccctcgcgccatcagacagtatatacacgaccggtgctcgatttagacgcgatcgaaggtttggggaagaggagatcgccgtgtttccactcggtgatcatcactgaacacagaggactcaccatggagttgggctgagctgggttttcctcgttgccctcttaaaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgagggctgagtgggtggcaggtgtgtcatttcatggaggaaatcaagtctaccggtgatccgttgagggccgattcaccatctccagagacaattccgagaacacagttgtctcttcaaatgaacagcctgagacctcagggacacggccgtgtatttttgtgcgagactatctgtttccaaaatcggttcattcgacgcctggggccagggaccctggtcaccgtctcctcggcctccaccaagggcccatcggtcttccccctggcgcctgctccaggagcacctccgagagcacagcggccctgggctgcctggtcaaggactacttcctatatactgtctgagcgggctggcaaggcgcatag

SEQ ID NO: 790145 - DNA, 720 bp, Homo sapiens
  misc_feature: 7033.UNK.UNK.UNK.pb.heavy.1.raw 7033
cgatcgcctccctcgcgccatcagacagtatatacacgacggtgctcgatttagagtgagctcgttgggtttggggagctctgggagaggagcccagcaccagaagtcggcggtgtttccagtcggtgatcagcaccgaacacagaggactcaccatgggagtttgggctgacctgggttttcctcgttgctcttttaagaggtgtccagtgtcaggtgaagctggtggagtctgggggaggcgtgggtccagcctgggaggtccctgagactctcctgtgtagcgtctggattcaccttcaacagacatggcatgcactgggtccgccaggctccaggcaaggactggagtgggtggcacttatatgtatgatggaagtaataaatattatgtagattccgtgaagggcgattcaccatctccagagacaattcgaagaacacactatatctggaaatgaatagcctgaagccgaggacacggctgtctactactgtgcgagagatggggctcgtggatacagatatgacatgctctactccaatggtatggacgcctggggccaagggaccacggtcgccgtctcctcagcctccaccaagggcccatcggtcttcccctggcaccctcctccaagagcacctctggggcacagcggccctgggctgcctggtcaaggactacttcctatattactgtctgagcgggctggcaaggcg

SEQ ID NO: 790146 - DNA, 707 bp, Homo sapiens
  misc_feature: 7106.44.36.D03.1.pb.heavy.1.raw 7106
cgtatcgcctccctcgcgccatcagacagtatatacacgaccggtgctcgatttagctgcgtcacgatctctcttggggagctctgagagcggagccccagcccagaattcccaggtgttttcatttggtgatcagcactgaacacagaggactcaccatggagttcgggctgagctgggttttccttgttgttattttacaaggtgtccagagtgaagtgcagttggtggagtccggggggagacttggtccagcctggagggtccctgagactctcctgtgtcgcctctggattcaccatcagtgaccactatatggactgggtccgccaggcttccagggaaggggctggaggtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctcaccaagggcccatcggtcttccccctggcgccctgctccaggagcacctccgagagcacagcggccctgggctgcctggtcaaggactacttcctatattactgtctgagcgggctggcaaggcgcatag

SEQ ID NO: 790147 - DNA, 696 bp, Homo sapiens
  misc_feature: 7114.UNK.UNK.UNK.pb.heavy.1.raw 7114
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggcccccagtagtcaagcggggaccgtctcgaggggggctctcgccacaataatagacagccgtgtcctcacttgtgaggttgtacatttgcagatgcagtgtgttcctggaattgtctctggagacggtgaatcggcccttctcggagtctccgtagtgttcttcaattccatcttctgatataattgccacccactccagcccttgcctggagcctggcggaccagtgcatggcataggtcctgaagatgaatccagaggctgcacaggagagtctcagggagttcccaggctgggccgctcctcccccagactcactagctgcacctgacactgggccacctcttaaagagcaacgaggaaaacccatctcagcccaaagtcatggtggagtcctctgtgttcagtgatgatcaccgaatggaaacaccggcgacttccagtgctgggcctcgtctccccccctgagcgtagagctaaatcgagcacgcggtcgtgtatatactgtctgatggcgccgaagggaggcgatacg

SEQ ID NO: 790148 - DNA, 605 bp, Homo sapiens
  misc_feature: 7137.UNK.UNK.UNK.pb.heavy.1.raw 7137
cgtatcgcctccctcgcgccatcagacagtatatacacgacggtgctcgatttagtacacgtgattaggattggggcagggtgaacacctgtgttttcctcctgctggtggcagctcccagatgggtcctgtccaggtgcagctgcaggagtcgggccaggactggtgaggcttcggaacctgtctctcatctgcactgtctctgagtttccatcagttctgatcattcttgggcctggatccggcagccccagggaggggaatggagtggattggtgacatccattatactggggcgacgtactactctccgtccctcaagagtcgtctcaccatttcgaggacacgtccatgaaccgcttctccctgaaactgacctccgtgacccgcgcggacacggccgtttatttctgtgcgaggcgagactggtctttcaatctatggggccgtggcaccctggtcactgtctcctcagcttcaccaaggcccatcggtcttccccctggcgccctgctccaggagcacctctggggcacagcggccctggctgcctggtcaaggactacttcctatatactgtctgagcgggctggcaaggcgcatag

SEQ ID NO: 790149 - DNA, 620 bp, Homo sapiens
  misc_feature: 7142.UNK.UNK.UNK.pb.heavy.1.raw 7142
gaaggctgggcaggctatgcaccctggtccaggtcaaagctgcgaacccgctagcggccatcttggccactaggggtccgcagattcatattgtcgtctagcatgcgcacaatgctgcaaacccagcttgcaatgcccacagcaagcggcccaatctttacgcccacgttgaattgtttattacctgtgactggctatggcttgcaacgcactcgtaaaaaactagtactttgcggttaggggaagtagacaaacccattacttccactttcccggaagttcaactcattccaacacgaaataaaagtaaactcaaacaccccaagcaggctatgtgggggggtgataaggggtggattctatttcctatcccatccccgtaggatctcaattaagttactagcgagttaaatgtctgtagcgatcccgtcagtcctatcgcgcgcatcaagacctggttggttgaggcgtgcagtagaatcatcgataagctgcgagttaggtcatcccagaccgcatctggcggcctaaacgttcagtggtagctaaggcggtcaccttcgacctgtctaaaggcaatatgtcgtccttagctccaagtccctagcaagcgtgtcggg

SEQ ID NO: 790150 - DNA, 664 bp, Homo sapiens
  misc_feature: 7191.UNK.UNK.UNK.pb.heavy.1.raw 7191
cgtatcgcctccctcgcgccatcagacagtatatacacgaccggtgcttcgatttagtgctatagacttgggtttggggatgcttctgagagtcaaggacctcctgtgcaagaacatgaagcacctgtggtttttcctcctggctggtggcagctcccagatgggtcctgtcccaggtgcagctgcaggagtcgggcccaggactggtgaggccttcgggaaccctgtctctcatctgcactgtctctggagtttccatcagttcgatcattcttggggctggatccggcagccccccagggaggggaatggagtggattggtgacatccattatactggggcgacgtactactctccgtccctcaagagtcgtctcaccatttcgagggacacgtccatgaaccgcttctcccctgaaaactgacctcccggtgaccgcccgcggacaccggccgtttatttctgtgcgaggcgagactggtctttcaatctatggggccgtggcacctggtcactgtctcctcagcttccaccaaggggccccatcggtcttcccctggcgcctgctccaggagcacctctgggggggcacagcggccctgggctgcctggtcaaggactacttccctatatactgtctgagcgggctggcaaggcgcatag

SEQ ID NO: 790151 - DNA, 707 bp, Homo sapiens
  misc_feature: 7224.UNK.UNK.UNK.pb.heavy.1.raw 7224
cgtatcgcctccctcgcgccatcagtctatactatcacgaccggttgctcgatttagacgcgatcgaagggtttggggctgggagacgagcccagcactggaaggtcgccggtgtttccactcggtgatcatcactgaacacagaggactcaccatggagtttgggctgagctgggttttcctcgttgccctcttaagaggtgtcatgtgtcaggtgcaattcgtggagtctggggggaggcgtggccccagtaggggggtccctgagactctcctgtgcagcctctggattcaccttcgataattgggaatatgcagtgggtccgccaggctccaggcgaggggctggagtggggtggcaggtgtgtcatttcatggaggaaatcaagtctacggtgattccgtgagggccgattcaccatctccagagacaattccgagaacacagtgtctcttcaaatggaacagcctgagacctcaggaccggccgtgtatttttgtgcgagactatctgtttccaaaatcggtttcattcgacgcctggggccaggggaaccctggtcaccgtctcctcggcctccaccaaggggcccatcgtcttcccctggcgcccctgctccaggagcacctccgagaacagcggcctgggctgcctggtcaaggactacttcctatatactgtctgagcgggctggcaaggcgcatag

SEQ ID NO: 790152 - DNA, 702 bp, Homo sapiens
  misc_feature: 7237.UNK.UNK.UNK.pb.heavy.1.raw 7237
ctatgcgccttgccagcccgctcagacagtatataggaagtagtccttgaccaggcagccaggccgctgtgctctcggaggtgctcctggagcagggcgccagggggaagaccgatgggcccttggtggaggctgaggagacggtgaccagggttccctgggccccagtggacagttcctgatataaacacaaacacaataatacatgcccgtgtcctcggtttttcaggttagtcattcgcagaatcaatgagttcttgaagtcatctcttgagaggggtgaatctggctttcacagacgcggcgtactctgtgataaagctggcaactttgttttttactgcggccaagccactccagccccttccctggagcctggcggacccagtccatatagtggtcactgatggtgaatccagaggcgacacaggagagtctcaggaccctccaggctggaccaagtctcccccggactccaccaactgcacttcactctggacaccttgtaaaataacaacaaggaaaaacccagctcagcccgaactccatggtgagtcctctgtgttcagtgctgatcaccaaatgaaaacacctgggaattctggggctggggctccgctctcccccaagagagatcgtgacgccagctaaatcgagcaccggtcgtgtatatactgtctgatggcgcgaggaggcgatacg

SEQ ID NO: 790153 - DNA, 692 bp, Homo sapiens
  misc_feature: 7268.UNK.UNK.UNK.pb.heavy.1.raw 7268
cgtatcgcctccctcgcgccatcagacagtatatacacggaccggttgctcgattagcactcgcacgttggtttggggggggagaggagcccagccactgggattccgaggggttttccattcggtgatcagcactgaaacacagaggactcaaccatggagttttggctgagctggggttctccttgttggacttttaaaaggtgtccgtgtgaggtgcgctgaggatctgaggagcttagtccagctggggggtccagagacttcccttgcagcctctgggctcaccgtcagcagcaacacatgattgggtccgcccaggctccagggaaggggctggagtggggttcaagtcatttatactgtgatttcacatacacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctgggccaggaaccctggtcaccgtcgcctccgcctccaccaagggccatcggtcttcccctggcaccctcctccaagagcacctctggggcacagcgcctgggctgcctggtcaaggactacttcctatatactgtctgagcggctggcaggcgcatag

SEQ ID NO: 790154 - DNA, 700 bp, Homo sapiens
  misc_feature: 7316.44.67.G01.1.pb.heavy.1.raw 7316
cgtatcgcctccctcgcgccatcagacagtatatacacgaccggtgctcgatttagagtatacatattgggtttggggggagaggagcccagcactggattcgaggtgtttccattcggtgatcagcactgaacacagaggactcaccatggagttttggctgagctgggttctccttgttggacttttaaaaggtgtccagtgtgaggtggcggctgatggagtctggaggaggcttagtccagcctggggggtccagagactctcctgtgcagcctctgggctcaccgtcagcagcaactacatgagtgggtccgccaggctccagggaaggggctggagtggggtctcagtcatttatactggtgatttcacatactacgcagactccgtgaaggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctcaccaagggcccatcggtcttcccctggcaccctcctccaagagcacctctgggggcacagcggccctgggctgcctggtcaaggactacttcctatatactgtctgagcgggctggcaaggcgcatag

SEQ ID NO: 790155 - DNA, 660 bp, Homo sapiens
  misc_feature: 7335.UNK.UNK.UNK.pb.heavy.1.raw 7335
ctatgcgccttgccagcccgctcagacagtatataggaagtagtccttgaccaggcagcccagggccgctgtgctctcggaggtgctcctggagcagggcgccaggggggaagaccgatgggcccttggtggaggctgaggatgaggagacggtgaccgtggtcccttggcccccagacgtcccaagcgtagtagaattgagacgacctgccataggcggacccatgtctgacacagtagtagacagccgtgtcggcggcggccacagaactcactttcagggaaaactgtgtcctcgacgtgtccacggatatggtgactcgaccgttgagggacgggttgtagtaggtgttcccactataatagagactcccaatccactgcagcccctctcctgggggctggcggatccagccccagtagaaattacttctgtcgatggagggcaccagagaccgtggcacgtgagggacagggtctccgaaggcttcaccagtcctgggcccgactcccgcagctgcggctgagacaggacccatctgggagccgccaccagcaggaggaagaaccacaggtgcttccccccaaacccaacacactctctctaaatcgagcacccggtcgtgtatatactgtctgatggcgcgaggaggcgatacg

SEQ ID NO: 790156 - DNA, 701 bp, Homo sapiens
  misc_feature: 7337.44.27.C05.1.pb.heavy.1.raw 7337
ctatgcgccttgcagcccgctcagacagtatataggaagtagtccttgaccaggcagcccagggccgctgtgctctcggaggtgctcctggagcagggcgccagggggaagaccgatgggcccttggtggaggccgaggagacggtgaccagggttcctggccccaggcgtcgaatgaaaccgattttggaaacagatagtctcgcacaaaatacacggcgtgtcctgaggtctcaggctgttcatttgaagagacactgtgttctcggaattgtctctggaagatggtgaatcggcctcaacggaatcaccgtagacttgatttcctccatgaaatgacacacctgccacccactccagccctcgcctggagcctggcggacccactgcatattccaattatcgaaggtgaatccagaggctgcacaggagagtctcagggacccccctactggggccaccgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagccccaaacccttcgatcgcgtctaaatcgagcaccggtcgtgtatatactgtctgatggcgcgagggaggcgatacg

SEQ ID NO: 790157 - DNA, 700 bp, Homo sapiens
  misc_feature: 7363.44.55.E11.1.pb.heavy.1.raw 7363
ctatgcgccttgccagcccgctcagacgtatataggaagtagtcttgaccaggcagccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggcctggactaagcctcctccagactccatcagccgcacctcacactggacacctttaaaagtccaacaaggagaacccagctcagccaaaactccatggtgagtcctctgtgttcagtgctgatcaccgaatggaaacacctcggaatcccagtgctgggctcctctccccccaaaccaacgtgcgagtgctaaatcgagcaccggtcgtgtatatactgtctgatggcgcgagggaggcgatacg

SEQ ID NO: 790158 - DNA, 728 bp, Homo sapiens
  misc_feature: 7368.UNK.UNK.UNK.pb.heavy.1.raw 7368
cgtatcgcctccctcgcgccatcagacagtatatacacgacggtgctcgatttagtgctatagacttgggttggggagctctgggagaggagccagcaccagaagtcggccggtgttttccagtcggtgatcagcaccgaacacagaggacctcaccatggagtttggctgacctgggttttttcctcgttgctcttttaagaggtgtcccagtgtcaggtgaagctggtggagtctgggggaggcgtggtccagcctgggaggtcctgagacttcctgtgtagcgtctggattcaccttcaacagacatggcatgcactgggtccgccaggctcaggcaaggactggagtgggtggcacttatatggtatgatggaagtaataaatattatgtagattccgtgaagggccgattcaccatctccagagacaattcgaaagaacacactatatctggaaatgaatagcctgagagccgaggacacggctgtctactactgtgcgagagatggggctcgtggatacagatatgacatgctctactccaatggtatggaccgccctgggggccaaggaccacggtcgccgtctcctcagcctccaccaaggcccatcggtcttcccctggcacctcctccaagagcacctctgggggcacagcggccctgggctgcctggtcaaggactacttcctatatactgtctgagcgggctggcaaggcgcatag

SEQ ID NO: 790159 - DNA, 715 bp, Homo sapiens
  misc_feature: 7428.44.27.C05.1.pb.heavy.1.raw 7428
ctatgcgcccttgccagcccgctcagacagtatataggaagtagtcttgaccaggcagcccagcggccgctgtgctctcggaggtgctcctggagcagggcgcgcaggggggaagaccgatgggcccgttggtggagccgcgaggagacggtgaccagggttccctggccccaggcgtcgaatgaacccgattttggaaaaagatagtctccgcacaaaaatacacggccgtgtcgctgaggtctcaggctgttcattgagaagaacactgtgttcttccggaattgtctctggagatggtgaatccgccctcaacggaatcaccgtagacttgatttcctccatgaaatgacacacctgccacccactccagccctcgcctggagcctggcggacccactgcatattccaattatcgaaggtgaatccagaggctgcacaggagagtctcagggaccccccctactggggccacgcctcccccagactcccacgaattgcacctgacacatgacacctcttaagaagggcaacgagaacccagctcagcccaaactccatggtgagtcctctgtgttcagtgatgatcaccgagtggaaacaccggcgactctcagtgctgggctcgtctcccaggccccaaacccttcgatcgcgtctaaatcgagcaccggtcgtgtatataactgtctgatggcgcgagggaggcgatacg

SEQ ID NO: 790160 - DNA, 706 bp, Homo sapiens
  misc_feature: 7442.44.55.E11.1.pb.heavy.1.raw 7442
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggacccccaggctggactaagcctcctccagactccatcaggccgcacctcacactggacaccttttaaaagtccaacaaggagaacccagctcagccaaaactccatggtgagtcctctgtgttcagtgctgatcaccgaatggaaacactcggaatcccagtgctgggctcctctccccccccaaacccaacgtgcgagtgctaaatcgagcaccggtcgtgtatatactgtctgatggcggcgaggaggcgatacg

SEQ ID NO: 790161 - DNA, 450 bp, Homo sapiens
  misc_feature: 7469.44.46.E02.1.pb.heavy.1.raw 7469
ctatgcgccttgccagcccgctcagacagtatataggaagtagtccttgaccaggcagcccagggccgctgtgccccagaggtgctcttggaggagggtgccagggggaagaccgatgggcccttggtggaggctgaggagacggtgaccagggttccctggcccaggggtcgagccagttcgcccccccgtctctactgtatcgataggaatctctcgcacaataatatacggccgtgttcgcggcggtcacagaagtcaatttcagggagaactggttcttggacctgtctagtgacatggtgactcgactcttgagggcggggttgtagttggtgctgccactgttatagatgcgcccaatccactccagtccctttccctgtagatgagtctaaatcgagcaccggtcgtgtatatactgtctgatggcgcgagggaggcgatacg

SEQ ID NO: 790162 - DNA, 699 bp, Homo sapiens
  misc_feature: 7490.44.56.F01.1.pb.heavy.1.raw 7490
ctatgcgccttgccagcccgctcagacagtaataggaagtagtccttgaccaggcagcccagggccgctgtgccccagaggtgctcctggagcagggcgccaggggaagaccgatggcccttggtggaagctgaagagacggtgaccattgtcctggccccaaatatcaaatgcatcgacgtccaggatcgcctggcgcagtaatagacgcctgtgtcgtcggtctcaggttgctcatttgtaaatggccaacactgttggagtcatcccttgagacggtgaatcttccttcacagacgcggcgtactctttacttccaccataacgttcattctgacgaaagtgatccactcaagcccttccctggagcctgacggacccaggccaagtgataatcactaagactgaatcctgagactacacaggagagtctcagagaccgccctggctgtgccaagcccccccccgactccgccagtcgcccctcgcactggacaccttctaaaaaaactacaaggaaaatcaagattagcccaaactccatggttggtggtctgtgctcagtgctgatcaccaagtggaactcctgggaatctcacggctggggctcctctcccagcccctttgtgtgttcagacgtctgctaaatcgagcaccggtcgtgtatatactgtctgatggcgcgagggaggcgatacg

SEQ ID NO: 790163 - DNA, 684 bp, Homo sapiens
  misc_feature: 7497.44.27.C05.1.pb.heavy.1.raw 7497
ctatgcgccttgccagccgctcagacagtatataggaagtagtccttgaccaggcagcccaggccgctgtgctctcggaggtgctcctggagcagggcgccaggggggaagaccgatgggcccttggtggaggccgaggagacggtgaccagggttccctggcccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccaccactccagccctcgcctggagcctggcggacccactgcatattccaattatcgaaggtgaatccagaggctgcacaggaagtctcagggaccccccctactggggccacgcctccccagactccacgaattgcacctgaacacatgacacctcttaagagggcaacgaggaaaacccagctcagcccaaactccatggtgagtcctctgtgttcagtgatgatcaccgagtggaaacaccggcgacttcctcttccccccaaacccttcgatcgcgtctaaatcgagcaccggtcgtgtatatactgtctgatggcgcgaggaggcgatacg

SEQ ID NO: 790164 - DNA, 706 bp, Homo sapiens
  misc_feature: 7573.44.62.F07.1.pb.heavy.1.raw 7573
ctatgcgccttgccagcccgctcagacagtatataggaagtagtccttgaccaggcagcccagggccgctgtgctctcggaggtgctcctggagcagggcgccaggggaagaccgatgggcccttggtggaggctgaagagacggtcaccactgtccccggccccaagtactaaaggtgtcatgggggtcaccgtggtcctggctttcaaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagacccactccagtcccctccctggagcccggcggacccaggtcatgccataggcactaaaggtgaatccagaggccgcacaggagagggtcagggacctcccaggccgaatcaggccccccagactccaacaactgcacttcacacacgacaccctttaaaaagccacaagaaaaaggcagctcagcccaaactccatggagacttctctctgttcggtcctggtcaccaaatgaagacacctgaaaatcccagggctgggctcctctctcagagctcccctttccctttatgcgactactaaatcgagcaccggtcgtgtatatactgtctgatggcgcgagggaggcgatacg

SEQ ID NO: 790165 - DNA, 710 bp, Homo sapiens
  misc_feature: 7591.UNK.UNK.UNK.pb.heavy.1.raw 7591
cgtatcgcctccctcggcgcccatcagacagtattaccaccgaccccggtgctcgatttagacgcgatcgaagggttttggggggaagaggaagtcgccggtgtttccactcggggtgatccatcactgaaacacaggaggactcaccatggagttttgggctgagctggtttttcctccgttgccctcttaagaggtgtcatgtgtcaggtgcaattacgtggaagtctgggggaggcgtggccccagtaggcgggtccctgagactctcctgtgcagcctctggattcaccttcgataattggaatatgcagtgggtccgccaggctccaggcgaggggctggaggtgggtggcaggtgtgtcaatttcattggaggaaatcaagtctacggtgattccgttgagggcccgattcaccatctccagagacaattccgagaacacagtgtctcttcaaatgaacagcctgagacctcaggacacgggccgtgtatttttgtgcgagactatctgtttccaaaatcggttcattcgacgcctggggccagggaaccctggtcaccgtctcctccggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790166 - DNA, 704 bp, Homo sapiens
  misc_feature: 7598.44.36.D03.1.pb.heavy.1.raw 7598
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggtttttccttgttgttattttacaaggtgtccagagtgaagtgcagttggtggagtccggggagacttggtccagcctggagggtccctgagactctcctttgtcgcctctggattcaccatcagtgaccactatatggactggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790167 - DNA, 610 bp, Homo sapiens
  misc_feature: 7619.44.23.C01.1.pb.heavy.1.raw 7619
cgtatcgcctcccctcgcgcatcagacagtatatacacgaccggtgctcgattagtacacgtgattaggggattgggcagggtgaacacctgtggtttttcctcctgctgtggcagctcccagatgggtcctgtccaggtgcagctgcaggagtcgggcccagactggtgaggccttcgggaaccctgtctctctctgcactgtctctggagtttcatcagttctgatcattcttgggctggatccggcagcccccagggaggggaatggagtggattggtgacctccattatactgggcgacgtactactctccgtccctcaagagtcgtctcaccatttcgagggacaacgtccatgaaccgcttctccctgaaaactgacctccgtgaccgccgcgcggacacggccgttattctgtgcgagcgagactgtctttcaatctatggggccgtggcaccctggtcactgtctcctcagcttccaccaagggccatcggttcttccccctggcgccctgctccaggagcacctctggggcacagcggcctgggctgcctggtcaagactacttcctatatactgtctgagcgggctggcaaggcgcatag

SEQ ID NO: 790168 - DNA, 728 bp, Homo sapiens
  misc_feature: 7623.44.86.H09.1.pb.heavy.1.raw 7623
ctatgcgccttgccagcccgctcagacagtatataggaagtagtccttgaccaggcagcccagggccggctgtgcccccagaggtgctcttggaggagggtgccaggggggaagaccgatgggcccttggtggaggctgaggagacgcgaccgtggtcccttggcccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataaatttattacttcatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagaagctccccaacccaagtctatagcactaaatcgagcaccggtcgtgtatatactgtctgatggcgcgagggaggcgatacg

SEQ ID NO: 790169 - DNA, 710 bp, Homo sapiens
  misc_feature: 7659.44.36.D03.1.pb.heavy.1.raw 7659
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccccggccccagtagtcaaaaccagccactgaccaagtggcccgatctctcgaacagaagtagacagccgtgtcctcgtctctcaggctgttcatttccagatacagtgagttcttggcattgtccctggaattggtgaatcggcccttcacagagtctgcgtagtaggtggtatctccagcaatattaacatatgaaacccactccagccccttccctggagcctggcggacccagttcatggcatagtcactgaagatgaatccagaggctgcacaggagagtctcagggaccccccccgctgtaccaagcctccccagactccaccagccgcacctcacagtggacaccttctaaaatagcaacaaggaaaacccagcgcagccccaactccatggtgagtcctctgtgttcattgctgatcaccaagtggaaatgccttggaatccagggctaaggcacctctctgagagctcccaagagagatcgtgacgcagctaaatcgagcaccggtcgtgtatatactgtctgatggcgcgagggaggcgatacg

SEQ ID NO: 790170 - DNA, 614 bp, Homo sapiens
  misc_feature: 7663.44.38.D05.1.pb.heavy.1.raw 7663
cgtatcgcctccctcgcgccatcagacagtatatacacgaccggtgctcgatttagtatctgatagctgggttttcctgttgctattttaaaaaggtgtccagtgtgaggtgcagctggtggagtccggggaggcttagttcagcctggggggtccctgagactctcctgtgcagcctctgattcaccttcagtagctactggatgcactgggtccgccaagctccagggaaggggctggtgtgggtctcacgtattaatagtgatgggagtagcacaagctacgcggactccgtgaaggccgattcaccatctccagagacaacgccaagaacacgctgtatctgcaaatgaacagtctgagagccgaggacacggctgtgtattactgtgcaagagccggtgcgggagttcgggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaggactacttcctatatactgtctgagcgggctggcaaggcgcatag

SEQ ID NO: 790171 - DNA, 708 bp, Homo sapiens
  misc_feature: 7680.44.62.F07.1.pb.heavy.1.raw 7680
ctatgcgccttgccagcccgctcagacagtatataggaagtagtccttgaccaggcagcccaggccgctgtgctctcggaggtgctcctggagcagggcgccaggggggaagacgatgggcccttggtggaggctgaagagacggtcaccactgtcccccggccccaagtactaaaggtgtcatgggggtcaccgtggtcctggctttcaaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagacccactccagtcccctccctggagcccggcggacccaggtcatgccataggcactaaaggtgaatccagaggccgcacaggagagggtcagggacctcccaggccgaatcaggccccccagactccaacaactgcacttcacacacgacaccctttaaaaaagccacaagaaaaaggcagctcagcccaaactccatggagacttctctctgttcggtcctggtcaccaaatgaagacacctgaaaatcccagggctgggctcctctctcagagctcccctttccctttatgcgactactaaatcgagcaccggtcgtgtatatactgtctgatggcgcgagggaggcgatacg

SEQ ID NO: 790172 - DNA, 678 bp, Homo sapiens
  misc_feature: 7681.44.53.E09.1.pb.heavy.1.raw 7681
ctatgcgccttgccagcccgctcagacagtatataggaagtagtccttgaccaggcagcccagggccgctgtgctctcggaggtgctcctggagcagggcgccagggggaagaccgatggcccttggtggaggctgaggagacggtgaccagggttccctggcccgaatgaaaccatcccagacagtaatagacggctgtgtcctcggtgttcaggctgttcatctgcagagacaccgtatcttttgaatcatctcttgagatggtgaatctgcctttcacggtgcaggcgtagtctgctgtcccaccgtcagctttggttctaatacggccaacccactccagccccttccctggagcctggcggacccaggtcatccaggcgttactgaaagtgaatccagaggctgcacaggagagtctaagggactccccaggctttaccaaacctcccccagactccaccaactgcacctcacactggacaccttttaaatagcagcaaggaaaatccagctcagcccaaactccatggtgagtcctcgtgttcagtcctgatcactgaatgaaaacacctgggaatccaaggctgggctcctctcccagagctcagcacactctctctaaatcgagcaccggtcgtgtatatactgtctgatggcgcgagggaggcgatacg

SEQ ID NO: 790173 - DNA, 662 bp, Homo sapiens
  misc_feature: 7707.44.12.B01.1.pb.heavy.1.raw 7707
ctatgcgccttgccagcccgctcagacagtatataggaagtagtccttgaccaggcagcccagggccgctgtgccccagaggtgctcttggaggagggtgccagggggaagaccgatgggccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctcccactataatagatactccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacccatctgggagccgccaccagcaggaggaagaaccacaggtgcttcatgttctttgcacaggaggtccatgactctcagaaagcccccgcggaatctacactactaaatcgagcaccggtcgtgatatatagactgatggcgcgagggaggcgatacg

SEQ ID NO: 790174 - DNA, 717 bp, Homo sapiens
  misc_feature: 7731.44.85.H08.1.pb.heavy.1.raw 7731
ctatgcgccttgccagcccgctcagacagtatataggaagtagtccttgaccaggcagcccagggccgctgtgcccccagaggtgctcttggaggagggtgcaggggaagccgatgggccctggtggaggctgaggagacggtgaccgtggtcccccttggcccagacgtccataccgtagtagtagtcccagcaggtggtagtactacaatatgtcctcgcacagtaatacacagccgtgtctcggctctcaggctgttcatttgcagatacagcgtgttcttggaattgtttggagatggtgaatcggccttcacgagtctgcatagtatttattacttccatcataccatataaagtgccaaccccactccagccttgcgctggagctggcgggcccagtgcatgatagttactgaaaggtgaatcagacgctgcacaggagagtctcagggacctcccaggctggaccacgcctccccccagactccaccagctgcagcctgaacctgacacctcttaaaagagcaacgaggaaaaccagctcagcccaaactccgatgtgagtcctctgtgtttcagtgctgatcacgaatgaaaacgaccgccggacttctagtgctgggctcctctccccagagctccccgcgactgagtgatactaatcgagcaccggtcgtgtatatactgtctgatggcgcgaggcggggcgatacg

SEQ ID NO: 790175 - DNA, 640 bp, Homo sapiens
  misc_feature: 7747.44.86.H09.1.pb.heavy.1.raw 7747
cgtatcgcctccctcgcgccatcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtccaggtgcagctgcaggagtcgggcccaggactggtgaggccttcggaaccctgtctctcatctgcactgtctctggagtttccatcagttctgatcattcttgggctggatccggcagccccagggagggaatggagtggatggtgacatccattatactggggcgacgtactactctccgtccctcaagagtcgtctcaccatttcgaggacacgtccatgaaccgcttctccctgaaactgacctccgtgaccgccgcggacacggccgtttatttctgtgcgaggcgagactggtctttcaatctatgggccgtgcaccctggtcactgtctcctcagcttccacaagggccatcggtcttcccctggcgccctgctccaggagcactctggggcacagcggccctgggctgcctggtcaaggactacttcctatatactgtctgagcgggctggcaaggcgcatag

SEQ ID NO: 790176 - DNA, 694 bp, Homo sapiens
  misc_feature: 7793.44.72.G06.1.pb.heavy.1.raw 7793
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctgaccccagtagtcaatgagccacccagcgcctcccgcacaataatacacagccgtgtcctcgactctcagactgttcatttgcagatacagtgagttcttggcgttgtctctggagatggtgaatcggcccttcacagagtccacatagtgtgtctcagttccatctttcttcatgatggccacccactccagccccttccctggagcctggcggacccagttcatccaataactactaaaggtgaatccagaggctgcacaggagagtctcagggaccccccaggctggaccaagcctcccccagactccaccagttgcacctcacactggacaccttctaaaatagcaacaaggaaaacccagctcagttcccaattccatggtgagtcctctgtgctcagtgctgatcaccaagtggaaaggccttggagtccagggctaaaggctcctctctcccctttcccttgcagtcgtagctaaatcgagcaccggtcgtgtatatactgtctgatggcgcgagggaggcgatacg

SEQ ID NO: 790177 - DNA, 556 bp, Homo sapiens
  misc_feature: 7798.UNK.UNK.UNK.pb.heavy.1.raw 7798
ctatgcgcctgccagcccgctcagacagtattaggagtagtccttgaccaggcgcccagggccgctgtgcctcggaggtgccctgggcaggcgccaggggggaccgatggcccttggtggaggctgaggagacggtgaccagggttccctggccccacaagtcaagccgggctggtggctctcgcacagaatacacggccgtgtcccagatctcaggctgctcagttccatgtagactgtacctggggaggtgctcctggtcatacaactctgctggaacttctgggccaagcccgtgttgccatataggctcatccatcccatccactccagcccttgtccagcggcctgtcgcacccagttaatcataattgatgaacgtgtatccagaagccgtgcaggagatgtcactgaggcccaggcttcttcctcagcccagactgcacagctgtacctggagtgggaccgtcatctccctccccccaaacccaaacactccactaaatcgagcaccggtcgtgtatatactgtctgatggcgcgagggaggcgatacg

SEQ ID NO: 790178 - DNA, 706 bp, Homo sapiens
  misc_feature: 7878.44.27.C05.1.pb.heavy.1.raw 7878
cgtatcgcctccctcgcgccatcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcacatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcggctggcaaggcgcatag

SEQ ID NO: 790179 - DNA, 728 bp, Homo sapiens
  misc_feature: 7886.44.33.C11.1.pb.heavy.1.raw 7886
ctatgcgcttgccagcccgcttcagacagtatataggaagtagtccttgaccaggcagcccagggccgctgtgccccagaggtgctcttggaggagggtgccaggggaagaccgatggcctggtggaggctgaggagacggcgaccgtggtcccttggccccaggcgtccataaccattggagtagagcatgtcatatcttatccacgagcccatctctcgcacagtagtagacagccgtgtcctcggctctccaggctaattcatttcagaatatagtgtgttttcgaattgtctctggagatggtgaatcggcccttcaacgggaatctacataatatttattacttccatcaataccatataagtgccacccactccagtcccttgcctggagcctggcggacccagtgcatgccatgtctgttgaaggtgaatccagacgctacatcaggagaggtctcaggacctcccaggctggaacacgcctcccagactccacccagcttcacctgacactggacacctcttaaaagagcaacgaggaaaaccccaggtcagcccaaactccatggtgagtcctctgtgttcggtgctgatcaccgacggaaacaccgccgacttctggtgctgggctcctctcccagagctccccaaacccaacgagctcactctaaatcgagcaccggtcgtgtatatactgtctgatggcgcgagggaggcgatacg

SEQ ID NO: 790180 - DNA, 585 bp, Homo sapiens
  misc_feature: 7889.44.36.D03.1.pb.heavy.1.raw 7889
cgtatcgcctccctcgcgccatcagacagtatatacacgaccggtgctcgatttagctgcgtcacgatctctcttgggtcttgtcccaggtcaccttgaaggagtctggtcctgtgctggtgaaacccacagagaccctcacgctgactgcaccatctctggttctctctcaacgatattagaatggtgtgagctggatccgtcagcccccaggaaggccctggagtggcttgcacacatcttctcgaatgacgaaaaatcctacagtacatctctgaagagcagtttaaccatctcaaggacacctccaaaaggcaggtggtctttagtatgaccaacatggaccctgcggacacaggcacatattactgtgcacggtaatgcgggaaagaaacagctggtttctgtattataagtcttaccatctggacgtctgggcaagggaccacggtcaccgtctcctcagcttccaccaagggcccatcggtcttccccctggcgccctgctccaggagcacctctggggcacagcggccctggctgcctggtcaaggactacttcctatatactgtctgagcgggctg

SEQ ID NO: 790181 - DNA, 696 bp, Homo sapiens
  misc_feature: 7916.UNK.UNK.UNK.pb.heavy.1.raw 7916
catatcgccttcggcgccatcagaaagtatatacacgaccggtgctgcgatttagcactcgccagattggttttggggggagaggagcccagcactgggatcccgaggtgtttccattcggtgatcagcactgagcacccagaggactcaccatggagtttggctgaagctggagttctcttttgttggacttttaaaagtgtccagtgtgaggtgcggctgatcgagtctggaggagcttagtccagctggggggtccagagactctcctgtgcagcctctgggctcaccgtcagcagccaactacatgagttgggtccgccaggctcagggaaggggctgagtgggtctcagtcatttatactggtgatttcacatactacgcagactcgtgaaggccgattcacccatctccaggacaattccagaacacggttttatcttcaaatgaacaacctgagaggcgacgacacggccgtctattactgtgtgagacaagtcggcgctcggagtggttattattcgtttgacttctggggcagggaaccctgtcaccgtcgcctccgcctcaccaaagggcccatcggtcttcccctggcaccctcctcaagagcacctctggggcacagcggccctgggctgcctggtcaaggactacttcctatatactgtctgagcggctggcaaggcgcatag

SEQ ID NO: 790182 - DNA, 673 bp, Homo sapiens
  misc_feature: 7922.44.45.E01.1.pb.heavy.1.raw 7922
cgtatcgcctcctcgcgccatcagacagtatatacacgaccggtgctcgatttagtgagtcagtaagggaaaggggctggagaggagcccagcactagaagtcggcggtgtttccattcggtgatcagcactgaacacagaggactcaccatggagtttgggctgagctgggttttcctcgttgctctttaagaggtgtccagtgtcaggttcagctggtggagtctgggggaggcgtggtccagcctgggacgtccctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgatctccgtctccagagacaatccaagaacaccgtgtatctacaaatgaacaatttgagagccgaggactccgctctctattattgtacgagcccatcgttctactgggccaggagccctggtcaccgtctctcagcctccaccaagggcccatcggtcttcccctggcgccctgctccaggagcacctccgagagcacagcggccctgggctgcctggtcaaggactacttcctatatactgtctgagcgggctggcaggcgcatag

SEQ ID NO: 790183 - DNA, 702 bp, Homo sapiens
  misc_feature: 7976.UNK.UNK.UNK.pb.heavy.1.raw 7976
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggccccagtggacagtcctgatataaacacaacacgaataataccatgcccgtgtcctcggtttcaggttagtcattcgcagaatcaatgagttcttgaagtcatctcttgagagggtgaatctggctttcacagacgcggggccgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacacgccttgtaaaataacaacaaggaaacctagctcagcccgaactccatggtgagtcctctgtgttcagtgctgatcaccaaatgaaaacacctgggaattctggggctgggctccgctctcccccaagagagatcgtgacgcagctaaatcgaggcaccggtcgtgtatatactgtctgatggcgcgagggaggcgatacg

SEQ ID NO: 790184 - DNA, 703 bp, Homo sapiens
  misc_feature: 7979.44.55.E11.1.pb.heavy.1.raw 7979
ctatgcgccttgccaagcccgctcagacagtatataggaagtagtccttgaccaggcagcccagggccgctgtgcccccagaggtgctcttggaggagggtgccaggggaagaccgatgggcccttggtggaggcggaggcgacggtgacccagggttccctggccccagaagtcaaacgaataataaccactccgagcgccgacttgtctcgcacagtaatagacggccgtgtcgtcgcctctcaggttgttcatttgaagataaaccgtgttcctggaatttgtccctggagatggtgaatcggcccttcacggagtctgcgtagtatgtgaaatcaccagtataaatgactgagacccactccagcccctccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccaaacccaacgtgcgagtgctaaatcgagcaccggtcgtgatagtatagactgatggcgcgagggaggcgatacg

SEQ ID NO: 790185 - DNA, 610 bp, Homo sapiens
  misc_feature: 8018.UNK.UNK.UNK.pb.heavy.1.raw 8018
aggctggcaggctatgcaccctggtccaggtcaaaagctgcggaacccgctagcggcatcttggccactaggggtcccgcagattcatattgtcgtctagcatgcacaatgctgcaaacccagcttgcaatgcccacagcaagcggccaatctttacgccacgttgaattgttttattacctgtgactggctatggcttgcaacgcccactcgtaaaactagtactttgcggtttaggggaagtagacaaacccattactccacttcccggaagttcaactcattcccaacacgaaataaaagtaaactcaacacccaagcaggctatgtgggggggtgataggggtggattctatttcctatcccatcccctaggatctcaattaagttactagcgagttaaatgtctgtagcgatcccgtcagtcctatcgcgcggcatcaagacctggttggttgagcgtgccagtagatcatcgataagctgcgagttaggtcatccagacgcatctggcgcctaaacgttcagtggtagctaaggcgtcaccttcgactgtctaaaggcaaatatgtcgtccttagctccaagtccctagcaagcgcgtgtcggg

SEQ ID NO: 790186 - DNA, 677 bp, Homo sapiens
  misc_feature: 8025.UNK.UNK.UNK.pb.heavy.1.raw 8025
cgtatcgcctccctcgcgccatcagacagtatatacacgaccgtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctggggaggcgtggtccagcctgggacgtcctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcgctctctattattgtacgagcccatcgttctactgggccagggagccctggtcaccgtctcctcagcctccaccaaggcccatcggtcttccccctggcgccctgctccaggagcacctccgagagcacagcggccctgggctgcctggtcaaggactacttcctatatactgtctgagcgggctggcaaggcgcatag

SEQ ID NO: 790187 - DNA, 732 bp, Homo sapiens
  misc_feature: 8041.44.33.C11.1.pb.heavy.1.raw 8041
cgtatcgcctccctcgcgccatcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctggggaggcgtggtccagcctgggaggtccctgagactctcctgtgtagcgtctggattcaccttcaacagacatggcatgcactgggtccgccaggctccaggcaagggactgaaagtgggtggcacttatatggtatgatggaagtaataaatattatgtagattccgtgaaggccgattcaccatctccagagagcaattcgaagaacacactaatactggaaatgaatagcctgagagccgaggacacggctgtcctactactgtgcgagagatggggctcgtggatacagatatgacccatgctctactcaatggtatggacgcctgggccaagggaccacggtcgccgtctcctcagcctccaccaagggcccatcggtcttccccctggcaccctcctccaagagcacctctgggggcacagcggcctgggctgcctggtcaaggactactgtcctatatactgtctgagcgggctggcaaggcggcatag

SEQ ID NO: 790188 - DNA, 700 bp, Homo sapiens
  misc_feature: 8042.44.62.F07.1.pb.heavy.1.raw 8042
ctatgcgctttgccagcccgctcagacagtatataggaagtagtccttgaccaggcagcccagggccgctgtgctctcggaggtgctcctggagcagggcgccaggggaagaccgatgggcccttggtggaggctgaagagacggtcaccactgtccccggccccaagtactaaaggtgtcatgggggtcaccgtggtcctggctttcaaacagtaatagacgcctgtgtcctcgggtctcaggttttcatttggagaaacaatttgtcctgcgattgtccctggaaatggtgaagcggcccttcacggagtctccgtagaaagtgacaccacagcctccgatacttgagacccactccagtcccctccctggagcccggcggacccaggtcatgccataggcactaaaggtgaatccagaggccgcacaggagagggtcagggacctcccaggcgaatcaggccccccagactccaacaactgcacttcacacacgacaccctttaaaaaagccacaagaaaaaggcagctcagcccaaactccatggagacttctctctgttcggtcctggtcaccaaatgaagacacctgaaaatccaggctgggctcctctctcagagctccctttccctttatgcgactactaaatcgagcaccggtcgtgtatatactgtctgatggcgcgaggaggcgatacg

SEQ ID NO: 790189 - DNA, 610 bp, Homo sapiens
  misc_feature: 8046.UNK.UNK.UNK.pb.heavy.1.raw 8046
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatcttacgccacgttgaattgtttattacctgtgactgggctatggcttgcaacgccactcgtaaaaactagtactttgcggttaggggaagtagacaaacccattactccacttcccggaagttcaactcattccaacacgaaataaaagtaaactcaacaccccaagcaggctatgtgggggggtgataggggtggattctatttcctatcccatcccctaggattctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 790190 - DNA, 715 bp, Homo sapiens
  misc_feature: 8068.44.85.H08.1.pb.heavy.1.raw 8068
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccgtggtcccttggccccagacgtccataccgtagtagtagtcccagcaggtggtagtactacaatatgtcctcgcacagtaatacacagtcgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctcccccagactccaccagctgcacctgacactggacacctcttaaaagagcaacgaggaaaaccagctcagccaaactccatggtgagtcctctgtgttcagtgctgatcaccgaatggaaacaccgccgacttctagtgctgggctcctctcccccccgcgactgagtgatactaaatcgagcaccggtcgtgtatatactgtctgatggcgcgagggaggcgatacg

SEQ ID NO: 790191 - DNA, 599 bp, Homo sapiens
  misc_feature: 8102.UNK.UNK.UNK.pb.heavy.1.raw 8102
gaaggctgggcaggctatgcaccctggtccaggtcaaagctgcggaaccgctagcggccatctggccactaggggtccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttagggaagtagacaaacccattactccacttcccgaagttcaactcattccaacacgaaataaaagtaaactcaacaccccaagcaggctatgtgggggggtgatagggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtgtagctaaggcgtcaccttcgactgtctaaaggcaatatgtcgtccttagctccaagtccctagcagcgtgtcggg

SEQ ID NO: 790192 - DNA, 606 bp, Homo sapiens
  misc_feature: 8117.UNK.UNK.UNK.pb.heavy.1.raw 8117
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacacccaagcaggctatgtggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 790193 - DNA, 648 bp, Homo sapiens
  misc_feature: 8126.UNK.UNK.UNK.pb.heavy.1.raw 8126
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatttcccttatgagactactaaatcgagcaccggtcgtgtatatactgtctgatggcgcgagggaggcgatacg

SEQ ID NO: 790194 - DNA, 697 bp, Homo sapiens
  misc_feature: 8129.UNK.UNK.UNK.pb.heavy.1.raw 8129
cgtatcgcctccctcgcgccatcagacagtatatacacgaccgtgctcgatttagcactcgcacgttggtttggggagaggagcccagcactggattccgaggtgtttccatccggtgatcagcactgaacacagaggactcaccatggagttttggctgagctgggttctccttgttggacttttaaaaggtgtccagtgtgaggtgcggctgatggagtctggaggaggcttagtccagcctggggggtccagagactctcctgtgcagcctctgggctcaccgtcagcagcaactacatgagttgggtccgccaggctccagggaaggggctggagtgggtctcagtcatttatactggtgatttcacatactacgcagactccgtgaaagggccgattcaccatctccagggacaatccaggaacacgtttatcttcaaatgaacaacctgagaggcgacgacacggccgtctattactgtgcgagacaagtcggcgctcggagtggttattattcgtttgattctggggccagggaaaccctggttcaccgtcgcctccgcctccaccaagggcccatcgtcttcccctggcaccctcctccaagagcacctctgggggcacagcggccctgggctgcctggtcaaggactacttcctatatactgtctgagcgggctggcaaggcgcatag

SEQ ID NO: 790195 - DNA, 695 bp, Homo sapiens
  misc_feature: 8143.44.27.C05.1.pb.heavy.1.raw 8143
ctatgcgccttgccagccgctcagacagtatataggaagtagtccttgaccaggcagcccagggccgctgtgcctcggaggtgctcctggagcagggcgccaggggaagaccgatgggccccttggtggaggccgaggagacggtgaccagggttcctggccccaggcgtcgaatgaaaccgattttggaaacagattagttcgcacaaaatacacggccgtgtcctgaggtctcaggctgttcatttgaagagacactgtgttctcggaattgtcttctggagatggtgaatcggccctccaacgaatccccgtagacttgatttcctccatgaaatgacacacctgccaccccactccagccctcgcctggagcctggcggacccactgcatattccaattatcgaaggtgaatccagaggctgcacaggagagtctcagggaccccctactgggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagccccaaacccttcgatcgcgtctaaatcgagcaccggtcgtgtatatactgtctgatggcgcgagggaggcg

SEQ ID NO: 790196 - DNA, 597 bp, Homo sapiens
  misc_feature: 8174.UNK.UNK.UNK.pb.heavy.1.raw 8174
gaagggcggcaggctatgcaccctggtccaggtcaaaagctgcggaacccgctagcggccatctggccactaggggttccgcagattcatattgtcgtctagcagcacatgctgcaaacccagcttgcaatgcccacagcaagcggccaatctttacgcacgttgaattgtttattactgtgactggctatggcttgcaacgccactcgtaaactagtacttgcggttagggaagtagacaaacccattactccacttccggaagttcaactcattccaacacgaaataaaagtaaactcaacaccccaagcaggctatgtggggggggtgataagggtggattctatttcctatccatccctaagggatctcaattaagttactagcgagttaaatgtctgtagcgatccgtcagtcctatcgcgcgcatcaagacctggtggttgagcgtgcagtgatcatcgataagctgcgagttaggtcatcccagaccgcatctggcgcctaaacgttcagtggtagctaaggcgtcaccttcgactgtctaaaggcaatatgtcgtccttagctccaagtccctagcaaggcgtgtcggg

SEQ ID NO: 790197 - DNA, 692 bp, Homo sapiens
  misc_feature: 8186.UNK.UNK.UNK.pb.heavy.1.raw 8186
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccgaggggttccctgacccagtagttcaatgagccacccaggcgcctcccgcacaataatacacagccgtgtcctcgactctcagactgttcatttgcagatacagtgagttcttggcgttgtctctggagatggtgaatcggccttcacagagtccacatagtgtgtctcagttccatctttcttcatgatggccacccactcagccccttccctggagcctggcggacccagttcatccaataactactaaaggtgaatccagaggctgcacaggagagtctcagggacccccaggctggaccaagcctcccagactccaccagttgcacctcacactggacaccttctaaaatagcaacaaggaaaaccagctcagtcccaattccatggtgagtcctctgtgctcagtgctgatcaccaagtggaaaggccttggagtccagggctaaggctcctctctccccttttcccttgcagtcgtagctaaatcgagcacccgcgtcgtgtatatactgtctgatggcgcgagggaggcgatacg

SEQ ID NO: 790198 - DNA, 709 bp, Homo sapiens
  misc_feature: 8211.44.36.D03.1.pb.heavy.1.raw 8211
ctatgcgccttgccagcccgctcagacagtatataggaagtagtccttgaccaggcagcccagggccgctgtgctctcggaggtgctcctggagcagggcgccagggggaagaaccgatggggcccttggtggaggctgagagacggtgaccagggttccctggccccagtggacagttcctgatataaacacaacacaataaacatgcccgtcgtcctcggttttcaggttagtcattcgcagaatcaatgagttcttgaagtcatctcttgagagggtgggaatctggctttcacagacgccggcgtactctgtgataaagctggcaactttgttttttactgcggccaagccactccagccccttccctggagcctggcggacccagtccatatagtggtccactgatggtgaatccagaggcgacacaggagagtctcagggaccctccaggctggaccaagtctcccccggactccaccaactgcacttcactctggacacctgtaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaatcgagcaccggtcgtgtatatactgttctgatggcgcgagggaggcgatacg

SEQ ID NO: 790199 - DNA, 575 bp, Homo sapiens
  misc_feature: 8232.44.78.H01.1.pb.heavy.1.raw 8232
cgtatcgcctccctcgcgccatcagacagtatatacacgaccggtgctcgatttagtgtgagtagtttgggtttgggtggccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaaggccctatagtggcaacacgggctttgcccagaagttccaggcaggagttagtatgacaggagcacctccccaggtacagtctacatggaactgagcagcctgagatctgaggacacggccggtgtatttctgtgcgagagccaccagcacctggcttgacttgtggggccagggaaccctggtcaccgtctcctcagcctccaccaagggcccatcggtcttccccctggcgccctgctccaggagcacctcgagagcacaggcggccctgggctgcctggtcaaggactacttcctatatactgtctgagcgggctggcaaggcgcatag

SEQ ID NO: 790200 - DNA, 661 bp, Homo sapiens
  misc_feature: 8245.44.23.C01.1.pb.heavy.1.raw 8245
cgtatcgccctccctcgcgccatcagacagtatatacacgaccggtgctcgatttagtacacgtgattagggattgggggctttctgagagtcaaaggacctcctgtgcaagaacatgaagcacctgtgtttttcctcctgctggtggcagctcccagatgggtcctgtcccaggtgcagctgcaggagtcgggcccaggactggtgaggccttcgggaacctgtctctcatctgcactgtctctggagtttccatcagttctgatcatttcttggggctggatccggcagcccccagggagggaatggagtggattggtgacatccattatactggggccgacgtactactctccgtccctcaagagtcgtctcaccatttcgagggacacgtccaatgaaccgctttctccctgaaactgacctccgtgaccgccgcggacacggcccgtttatttctgtgcgaggcgagactggtctttcaatctatggggcccgtggcaccctggtcactgtctcctcagcttccaccaagggcccatcggtcttccccctggcggccctgctccaggagcaccttctgggggcacagcggccctgggctgcctggtcaaggactacttcctatatactgtctggagcgggctggcaaggcgcatag

SEQ ID NO: 790201 - DNA, 711 bp, Homo sapiens
  misc_feature: 8265.44.55.E11.1.pb.heavy.1.raw 8265
ctatgcgccttgccgcccgctcagacagtatataggaagtagtcctgaccaggcagcccaggccgctgttgcccccctcaaggtggctcttgaggagggtgccagggggaagacgatgggcccttgtggaggcggagggcgacggtgaccagggttccctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgatcggcccttcacggagtctgcgtagtatgtgaaatcaccagtatccaatgactgagacccactccagcccctttccctggagcctggcggacccaactcatgttagttgctgctggacggtgagccagaggctgcacaggagagtctctgggaccccccaggctggactaagcctcctccagactccatcagccgcacctcacactggacaccttttaaaagtccaacaaggagaacccagctcagccaaaactccatggtgagtccctcctgtttttaggtgccgtgctgatcacccgaatggaaacacctcggatcccagtgctgggctcctctcccacaaaccaacgtgcgagtgctaaatcgagcaccggtcgtggtatatactgtctgatggcgcgaggaggcgatacg

SEQ ID NO: 790202 - DNA, 726 bp, Homo sapiens
  misc_feature: 8271.44.36.D03.1.pb.heavy.1.raw 8271
cgtatcgcctccctccgcgccatcagaccagtatatacacgaccggtgctcgatttagctgcgtcacgatctctcttggggagctctgagagcggaggccccagcccccagcccagatttcccaggtgttttcatttggtgatcagcactgaacacagaggacctcaccatggagttcgggctgagctgggtctttccttgttgttattttacagaggtgtccagagtgaagtgcagttggtggagtcgggggagacttggtccagcctggaggcgtccctgagactctcctgtgtcgcctctggattcaccatcagtgaccactatatgcgactgggtccgccaggctccagggcaagggggctggagtggcttggccgcagtaaaaacaaagttgccagctttatcacagagtacggccgcgtctgtgaaagccagattcaccctctcaagagatgacttcaagaactcattgattctgcgaatgactaacctgaaaccgaggacacggggcatgtattattgtgttgtgtttatatcaggaactgtccactggggccaggggaaccctggtcaccgtctcctcagcctccaccaacgggcccatcggtcttccccactgggcgccctgctccaggaggcacctccgagagcacagcggccctgggctgcctggtcaaggactacttcctatatactgtctgagcgggctggcaaggcgcatag

SEQ ID NO: 790203 - DNA, 713 bp, Homo sapiens
  misc_feature: 8288.UNK.UNK.UNK.pb.heavy.1.raw 8288
ctatgcgccttgccagcccgctcagacagtatataggcaagtagtcccttgaccaggcagcccagggccgctgtgctctccggaggtgctcctggagcagggcgccagggggaagaccgatgggcccttggtggaggctgaggagacggtgaccagggttccctggccccagtagtcaagcggggaccgtctcgaggggctctcgcacaataatagaccacgtgtcctcacttgtgaggttgtacatttgcagatgcagtgtgttcctggaattgtctctggagacggtgaatcggcccttctcggagtctccgtagtgttcttcattccatcttctgatataattgccacccactccagccccttgcctggagcctggcggggaccccgggtgcatggcataggtctgaagatgaatccagaaggctgcacagagggattcagggacgtcccaggctgggccgcgtcctcgcgcggcggagactccactcagcggcttgcacctgtgacctggccccctttaaaagagccaacgaggaaaaaccctctcagcccaagtccatggtgagtcctctgtgttccagtgatgatcaccgaaatggaaccacccggcgacttcccagttgctgggctcgtcgtccccccctgagcgagagctaaatcgagcaccggtcgtgtatatactggtctgatggcgcgagggaggcgatacg

SEQ ID NO: 790204 - DNA, 685 bp, Homo sapiens
  misc_feature: 8301.44.56.F01.1.pb.heavy.1.raw 8301
cgtatcgcctcctcgcgccatcagacagtatatacacgaccggtgctcgatttagcagacgtctgaacacacaaaggggagctctgggagaggagcccagccgtgagattccaggagtttccacttggtgatcagcactgagcacagaccaccaaccatggagtttgggctaatcttgattttcttgtagttttttagaaggtgtccagtgcgagggcactggcggagtcggggggggcttgcacagccaggcggtctctgagactctcctgtgtagtctcaggattcagtctagtgatatcacttggcctgggtccgtcaggctccaggaaggggcttgagtgatcactttcgtcagaatgaaacgttatggtggaagtaaagagtacgccgctctgtgaagggaagattcaccgtctcaagggatgactccaacagtgttggccatttacaaatgagcaacctgagacccgacgacacaggcgtctattactgcgcaggcgatcctggacgtcgatgcatttgatattggggccaggggacaatggtcaccgtctcttcagcttcacaagggccatcgtcttccctggcgccctgctccaggagcactctgggggcacagcgccctgggctgcctgtcaaggactacttcctatatactgtctgagcgggctggcaggcgcat

SEQ ID NO: 790205 - DNA, 756 bp, Homo sapiens
  misc_feature: 8309.UNK.UNK.UNK.pb.heavy.1.raw 8309
ccgacccgtatcagtatccgtcgtgtccttgaccactccgcgcttgcccgatctccggacagccactcagacagtataatagcacgcccggtgctcgaatttagcactcgcacgttgggtttggggggagagggagcccagcactgggattccgaggtgtttccattcggtgatcagcactgaaacacagaggactcaccatggagttttggctgagctgggttctccttgttggacttttaaaaggtgtccagtgtgaggtgcggctgatggagtctggaggagcttagtccagcctggggggtccagagactctcctgtgcagcctctggctcaccgtcagcagcaactacatgagttgggtccgccaggctccagggaaggggctggagtgggtctcagtcatttatactggtgatttcacatactacgcagactccggtgaagggccgattcaccatctccagggacaattccaggaacacggtttatcttcaaatgaacaacctgagaggcgacgacacggccgtctattactgtgcgagacaagtcggcgctcggagtgggttatattcgtttgacttctggggccagggaacccctggtcaccggtcgcctccgcctccaccaagggcccatcggttcttccccctggcaccctcctccaagagcacctctggggcacagcggccctggggctgcctggtcaaggactacttcctatatactgtctgagcgggctggcaaggcgcatag

SEQ ID NO: 790206 - DNA, 613 bp, Homo sapiens
  misc_feature: 8310.44.38.D05.1.pb.heavy.1.raw 8310
cgtatcgcctccctcgcgccatcagacagtatatacacgaccggtgctcgatttagtatctgatagctgggttttcctgttgctattttaaaaggtgtccagtggaggtgcagctggtggagtccgggggaggcttagttcagcctgggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagaggccgaggacacggctgtgtattactgtgcaagagccggtgcgggagttcggggagtgcatactactacacggtatggacgtctggggccaaggaaccacggtcaccgtctcctcagcttccaccaagggcccatcggtcttcccggcgccctgctccaggagcacctctggggccacagcggccctgggctgcctggtcaaggactacttccctatatactgtctgagcgggctggcaaggcgcatag

SEQ ID NO: 790207 - DNA, 705 bp, Homo sapiens
  misc_feature: 8325.44.36.D03.1.pb.heavy.1.raw 8325
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcgcgtactctgtgataaagctggcaacttttgttttttactgcggccaagccactccagccccttccctggagcctggcggacccagtccatatagttggtcactgatggtgaatccagaggcgacacaggagagtctcagggaccctccaggctggaccaagtctcccccggactccaccaactgcacttcactctggacaccttgtaaaataacaacaaggaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgttgatggcgcgagggaggcgatacg

SEQ ID NO: 790208 - DNA, 723 bp, Homo sapiens
  misc_feature: 8345.UNK.UNK.UNK.pb.heavy.1.raw 8345
cgtattgccttccctcgcgcatcagacagtatatacacgaccggtgctcgatttagatcacttcagtcgccgggaaggagcccgcactagaagtctggcggtgtttccatcggtgatcagcactgaccagaggactcaccatggcagttgggctgagctgggtttttcctcgttgctcttttaagatggtgtccatgtcaggtgcagctgggggagtcttggggaggccgtggtccagcctgggaggtccctgagactctcctgtgcagcccgtctggattcaccagtccaacctatggcatgcacccgggtccgccaggcttccaggcaaggggctgggagtgggtggcacttatatggtatgatggaagtaataaattactatgccaggactccgtgaagggcccgattcaccaatcccagaggacaattccaagaacacgctgtaatctgcaaatgaacagcctgagaggccgaggacacggcttgtgtattactgtgcgaggacatattgtagtactaccaccctgctgggactactactacggtatggacgtctggggccaagggccacggtcaccgtctcctcagcctccaccagggcccatcggtcttccccctggcacctcctccaagagcacctctggggcacagcggccctggggctgcctggtcaaggactacttcctatatactgtctgagcggggctggcaggcgcatag

SEQ ID NO: 790209 - DNA, 707 bp, Homo sapiens
  misc_feature: 8351.UNK.UNK.UNK.pb.heavy.1.raw 8351
cgtatcgcctcctcgcgccatcagacagtatattacacgaccggttgctcgatttagcactcgcacgttgggtttgggggagagaggagcccagcactgggattccgaggtgtttcattcggtgatcagcactgaacacagaggactcaccatggagttttggctgagctgggtttctccttgttggactttttaaaaggtgtccagtgtgaggtgcggctgatggagtctggaggaggcttagtccagcctggcgggggtcccagagactctcctgtgcagcctctgggctcaccgtcagcagcaactacatgagttgggtccgccaggctccagggaaggggctggagtgggtctcagtcattatactgggtgatttcacatactacgcagactccgtgaagggccgattcaccatctccagggacaattccaggaacacggtttatcttcaatgaacaacctgagaggcgacgacacggccgtctattactgtgcgagacaagtcggcgctcggagtggttattattcgtttgacttctggggccagggaaccctggtcaccgtcgcctcccgcctccaccaagggccatcggtcttccccctggcaccctcctccaagagcacctctgggggcacagcggccctgggctgcctggtcaagactcttcctatatactgtctgagcgggctggcaaggcgcatag

SEQ ID NO: 790210 - DNA, 612 bp, Homo sapiens
  misc_feature: 8384.UNK.UNK.UNK.pb.heavy.1.raw 8384
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggaatcgctacagacatttaactcgctagtaacttaattgagatcctaggggatgggataggaaatagaatccacccctatcaccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgttaaagattggccgcttgctgtgggcattgcaagctgggttttgcagcattgtgcatgctagacgacaatatgaatctgcgggaacccctagtggccaagatggccgctagcgggttccgcagcttttgacctggaccagggtgcatagcctgcccaagccttc

SEQ ID NO: 790211 - DNA, 662 bp, Homo sapiens
  misc_feature: 8416.44.35.D02.1.pb.heavy.1.raw 8416
cgtatcgcctccctcgcgcatcagacagtatatacacgaccggtgctcgatttagcacacgatagttgggtttggggatactttctgagactcatggcctcctgcacaagaacatgaaacacctgtggttcttcctcctcctggtggcacctcccagatgggtcgtgtccgagtgcagctgcaggagtcgggcccaggacgggtgaagccttcgagaccctgtccctcacctgcaatgtctctggtggttacatcagtagttattattggagttggctgcggcagtccgccggaagggactggagtggattgggcgcatctataacagtgcagcaccactacaaccccggccctcagagtcgagtcaccatgtcactagacaggtccaagaaccagttctccctgaaatgacttctgtgacgccgcggacacggccgtatattattgtgcgagagattcctatcgatacagtagagacgggggggcgaacggctcgaccctgggccagggaaccctggtcaccgtctcctcagctccaccaagggcccatcggtcttccccctggcaccctcctccaagagcacctctgggggcacagcggccctggctgcctgtcaaggactactcctatatactgtctgagcgggctggcaggcgcatag

SEQ ID NO: 790212 - DNA, 694 bp, Homo sapiens
  misc_feature: 8421.UNK.UNK.UNK.pb.heavy.1.raw 8421
cgtatcgcctccctcgcgccatcagacagtatatacacgaccggtgctcgatttagctgcgtcacagatctctcttgggagctctgagagcggagccagccagaattccaggtgttttcatttggtgatcagcactgaacacagaggactcaccatggagttcgggctgagctggttttccttgttgttattttacaaggtgtccagagtgaagtgcagttggtggagtcgggggagaacttggtccagcctggagggtccctgagactctcctgtgtcgcctctgattcaccatcagtgaccactatatggactgggtccgccaggctccagggaaggggctggagtgggcttggccgccagtaaaaacaaagttgccagctttatcacagagtacgccgcgtctgtgaagccagattcaccctctcaagagatgacttcaagaactcattgattctgcgaatgactaacctgaaaaaccgaggacacggcatgtattattgtgtgtgtttatatcaggaactgtccactggggccagggaaccctggtcaccgtctcctcagcctccaccaagggccatcggtcttcccctggcgccctgctccaggagcacctccgagagcacagcggcccctggctgcctggtcaggactacttcctatatactgtctggcgggctggcaaggcgcatag

SEQ ID NO: 790213 - DNA, 704 bp, Homo sapiens
  misc_feature: 8432.44.56.F01.1.pb.heavy.1.raw 8432
cgtatcggcctccctcgcgccatcagacagtatatacacgaccggtgctcgatttagcagacgtctgaacaccaaagggagctctgggagaggagccccagccgtgagattcccaggagtttccacttggtgatcagcactgagcacagacaccaccatggagtttgggctaatctttgattttccttgtagtttttttagaggtgtccagtgcgaggggcgactggcggagtcgggggggggcttggcacagccagggcggtctctgagactctcctgtgtagtctcaggattcagtcttagtgattatcacttggcctgggtccgtcaggctccagggaaggggctgagtggatcactttcgtcagaatgaaacgttatggtggaagtaaagagtacgcccgcgtctgtgaagggaagattcccgtctcaagggatgactccaacagtgttggccattacaaatgagcaacctgagaccgcgacaccaggcgtctattactgcgccaggcgattcctgggacgtcgagcatttgatatttggggccagggggacaatggtcaccgtctcctttcagcttccaccaagggcccatcggtcttccccctggcgccctgctccaggagcactctggggcacagcggccctgggctgcctggtcagcttcctatatactgtctgagcgcggctggcaggcgcatag

SEQ ID NO: 790214 - DNA, 556 bp, Homo sapiens
  misc_feature: 8469.44.43.D10.1.pb.heavy.1.raw 8469
cgtatcgcctccctcgcgccatcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaacccctaacagtggtaacacaggctatgcacagaagttccagggcagagtcaccatgaccaggaacacctccataaacacagcctacatggaggctgagcagcctgagatctgaggacacggccgtgtattactgtgcgagatcccgaaagtattagcagctcgtcggggaggtggttcgacccctgggccagggaaccctggtcaccgtctcctcagcttccaccaaaggggcccatcggtcttccccctggcgccctgctccaggagcacctctggggggcacagcggccctgggctgcctggtcaaggactacttcctatatactgtctgagcgggctggcaagggcgcatag

SEQ ID NO: 790215 - DNA, 615 bp, Homo sapiens
  misc_feature: 8545.UNK.UNK.UNK.pb.heavy.1.raw 8545
ctatgcgccttgccagcccgctcagacagtatataggaagtagtccttgaccaggcagcccagggccgctgtgcccccagaggtgctctggagcagggcgccagggggaagaccgatgggcccttggtggaagctgaggagacagtgaccagggtgccacggccccatagattgaaagaccagtctcgctcgcacagaaataaacggccgtgtccgcggcggtcacggaggtcagtttcagggagaagcggttcatggacgtgtccctcgaaatgtgagaccgactcttgagggacggagagtagtacgtcgccccagtataatggatgtcaccaatccactccattcccctccctggggctgccggatccagccccaagaatgatcagaactgatggaaactcagagacagtgcagatgagagacagggttccaaaggcctcaccagtcctgggcccgactcctgcagctgcacctgggacaggacccatctgggagctgccaccagcaggaggaaaaacacaggtgttcacctgccccaatccctaatcacgtgtactaaatcggagcaccggtcgtgtatatactgtctgatggcgcgagggaggcgatacg

SEQ ID NO: 790216 - DNA, 692 bp, Homo sapiens
  misc_feature: 8565.44.72.G06.1.pb.heavy.1.raw 8565
ctatgcgccttgccagcccgctcagacagtatataggaagtagtccttgaccaggcagcccagggccgctgtgctctcggaggtgctctggagcagggcgccagggggaagaccgatgggcccttggtggaggctgaggagacggtgaccagggttccctgaccccagtagtcaatgagccacccagcgcctccccgcacaataatacacaagccgtgtctcgactctcagactgttcatttgcagatacagtgagttcttggcgttgtctctggagatggtgaatcggcccttcacagagtccacatagtgtgtctcagttccatctttcttcatgatggccacccactccagccccttccctggagcctggcggaccagttcatccaataactactaaaggtgaatccagaggctgcacaggagagtctcaggggaccccccaggctggaccaagcctccccagactccaccagttgcacctcacactggacaccttctaaaatagcaacaaggaaaaacccagctcagtcccaattccatggtgagtcctctgtgctcagtgctgatcaccaagtggaaaggccttggagtccagggctaaggctcctctctcccctttccttgcagtcgtagctaaatcgagcaccggtcgtgtatatactgtctgatggcgcgagggaggcgatacg

SEQ ID NO: 790217 - DNA, 572 bp, Homo sapiens
  misc_feature: 8566.44.78.H01.1.pb.heavy.1.raw 8566
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggcccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggcttcttcacctcagcagcgtggtgaccgtgacctccagcaacttcggcacccaaacccaaactactcacactaaatcgagcaccggtcgtgtatatactgtctgatggcgcgagggaggcgatacg

SEQ ID NO: 790218 - DNA, 658 bp, Homo sapiens
  misc_feature: 8592.44.12.B01.1.pb.heavy.1.raw 8592
cgtatcgcctccctcgccgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcagagtcgggccaggactggtgaagccttcggagaccctgtccctcacctgcactgtctctggtggctccatcagcagtagtagttactactgggctggatccgccagccccagggaagggggctggagtggattgggagtatctattatagtgggagcacctactacaacccgtccctcaagagtcgagtcaccatatcagtagacacgtcaagaaccagttctccctgaagctgagctctgtgaccgccgcggacaccggccgtgtatactgtgcgagagtagggcagttcgtcaccaactactttgaccactggggccagggaaccctggtcaccgtctcctcagcctcacaagggcccatcggtcttcccctggcaccctcctccaagagcacctctgggggcacagcggccctggctgcctggtcaaggactacttcctatatactgtctgagcgggctggcaaggcgcatag

SEQ ID NO: 790219 - DNA, 614 bp, Homo sapiens
  misc_feature: 8722.UNK.UNK.UNK.pb.heavy.1.raw 8722
gaaggctggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcgccaatctttacgccacgttgaattgtttattacctgtgactggctatggcttttgcaacgccactcgtaaaactagtactttgcggttaggggaagtagacaaacccattactccacttcccggaaagttcacaactcattccaacacgaaaataaaagtaaactcaacaccccaagcaggctatgtgggggggtgataggggtggattctatttcctatcccatccctaggatctcaattaagttactagcgagttaaatgtctgtagcgatcccgtcagtcctatcgcgcgcatcaagaccctggttggttgagcgtgcagtagatcatcgataagctgcgagttaggtcatccagaccgcatctggcgcctaaacgttcagtggtagctaaggcgtccaccttcgactgtctaaaggcaaatatgtcgtccttagctccaaggtccctagcaagcgtgtcggg

SEQ ID NO: 790220 - DNA, 655 bp, Homo sapiens
  misc_feature: 8736.44.86.H09.1.pb.heavy.1.raw 8736
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacgaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctggggccccgactccgcagctgcacctgggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 790221 - DNA, 672 bp, Homo sapiens
  misc_feature: 8747.UNK.UNK.UNK.pb.heavy.1.raw 8747
cgtatcgcctccctcggcgcgcatcagacagtatatacacgaccggtgctcggatttagtagtgtagattccgcgggggctttctgagagtcatggacctcctgtgcaagaacatgaagcacctgtggttcttcctctgctggtggcggctcccagatgggtcctgtcccagctgcagctgcaggagtcgggcccaggacctgggaagccttcggagggacctgtccctcacgctggcactgtctctggtgcgcctcccatcagcagtagtagttactactggggctgatccgccagccccccagggaaaggggctggagtgggatttgggagtatctattatagtgggagcacctactacaacccgtccctcaagagtcgagtcaccatatcagtgacacgtccaagaaccagttctcctgaagctgagctctgtaccgccgcggacacggccgtgtattactgtgcgagagtagggcagttcgtcaccaactactttgaccactggggccagggaaccctgtcaccgtctcctcagcctcccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 790222 - DNA, 601 bp, Homo sapiens
  misc_feature: 8760.UNK.UNK.UNK.pb.heavy.1.raw 8760
gaaggcctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccatctttacgccacgttgaattgtttattacctgtgactggctatggcttgcaacgccactcgtaaaactagtactttgcggttagggaagtagacaaaccattactccacttcccggaagttcaactcattcaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcataagacctggttggttgagcgtgcagtagatcatcgataagctgcgagttaggtcatcccagaccgcatctggcgcctaacgttcagtggtagctaaggcgtcaccttcgactgtctaaaggcaatatgtcgtccttagcccaagtccctagcagcgtgtcggg

SEQ ID NO: 790223 - DNA, 722 bp, Homo sapiens
  misc_feature: 8766.UNK.UNK.UNK.pb.heavy.1.raw 8766
cgtatcgcctccctcgcgccatcagacagtatatacacgccgacggtgctcgattagctgcgtcacgatctctcttggggagctctgagagcggagccccagcccccagaattcccaggtgttttcatttggtgatcagcactggaacacagaggcactcaccatggagttcggggctgagcggttttccttgttgttattttacaaggggtccagagtgaagtgcagttggtggagtccgggggagacttggtccagccctggaggtcctgagactctcctgtgtcgcctctgggattcaccccatccagtgacccactatatggaccggggtccgccaggcccccagggaaggctggagtggcttggccgcagtaaaaaacaaaagttgccagcttatccacagagtacggccgcgtctgtgaaaggccagattcaccctctcaagagatgacttcaagaactcattgattctgcgaatgactaacctgaaaaccgaggacacgggcatgtattattgtgttgtgttgtatatcaggaactgtccactggggccaggggaaccctggtcaccgtctcctcagccctccaccaagggccatcggtcttccccctggcgccctgctccaggagcacctccgagagcacagcggccctgggcttgcctggtcaaggactccctcctatatactgtctgagcggggcttggcaaaggcgcatag

SEQ ID NO: 790224 - DNA, 682 bp, Homo sapiens
  misc_feature: 8791.44.35.D02.1.pb.heavy.1.raw 8791
ctatgcgccttgccagcccgctcagacagtatataggaagtagtccttgaccaggcagcccagggccgcctgtgcccccagaggtgctcttggaggagggtgccaggggaagaccggatgggcccttggtggaggctgaggagacggtgaccagggttccctggccccaggggtcgagccagttcggccccccgtctctactgtatcgataggaatctctcgcacaataatattacggccgtgtccgcggcggtcacagaagtcaatttcagggagaactggttcttggacctgtctagtgacatggtgactcgactcttgagggcgggttgtagttggtgctgccactgtatagatgcgcccaatccacctccagtccctcccggcggactgccgcagccaactccaataataagctactgatgtaaccaccagagacattgcaggtgagggacagggtctccgaaggcttcacccgtcctgggcccgactcctgcagctgcacctcggacacgacccatctgggaggtgccaccaggaggaggaagaaccacaggtgttttcatgttcttgtgcaggaggcccatgagtctcagaaagtatccccaaacccaactatcgtgtgctaaatcgagcaccggtcgtgtatatacgtctgatggcgcgcgagggaggcgatacg

SEQ ID NO: 790225 - DNA, 687 bp, Homo sapiens
  misc_feature: 8803.44.73.G07.1.pb.heavy.1.raw 8803
ctatgcgccttgccagcccgctcagacagtatataggaagtagtccttgaccaggcagcccagggccgcctgtgctctcggaggtgctcctggagcagggcgccaggggaagaccgatgggcccttggtggaggctgaggagacggtgaccagggttccctggccccagtagtcaagcggggaccgtctcgagggggctctcgcacaataatagacagccgtgtcctcacttgtgaggttgtacatttgcagatgcagtgtgttcctggaattgtctctggagacggtgaatcggcccttctcggagtctccgtagtgttcttcaattccatcttctgatataattgccaccactccagccccttgcctggagcctggcggaccagtgcatggcataggtcctgaagatgatccagaggctgcacaggagagtctcaggagttcccaggctgggcgctcctcccccagactccactagctgcacctgacactggccacctcttaaaaagagcaacgagaaaaccccatctcagcccaaagtccatggtgagtcctctgtgtttcagtgatgatcacgaatggaaacaccggcgacttccagtgctggctcgtctccccccctgagcgtagagctaaatcgagcaccggtcgtgtatatactgtctgatggcgcgagggaggcgatac

SEQ ID NO: 790226 - DNA, 681 bp, Homo sapiens
  misc_feature: 8814.UNK.UNK.UNK.pb.heavy.1.raw 8814
cgtatcgcctccctcgcgcatcagacagtatatactacgaccggtgctcgatttagagagagtgtgttgagctctgggagagagccccagccttggattcccaggtgttttcatcagtgatcaggactgaacacagaggactcaccatggagtttgggctgagctggattttccttgctgctattttaaaaggtgtccagtgtgagtgcagttggtggagtctggggaggtttggtaaagcctggggagtcccttagactctcctgtgcagcctctggattcactttcagtaacgcctggatgacctgggtccgccaggctccagggaaggggctgagtgggttgccgtattagaaccaaagctgacggtgggacagcagactacgctgcacccgtgaaaggcagattcaccatctcaagagatgattcaaaagatacggtgtctctgcagatgaacagcctgaacaccgaggacacaggccggtctattactgtctgggatggtttcattcgggccagggaaccctgggtcaccgtctcctcagcctccaccaaggggccatcggtctccccctggcgcgccctgctccaggagcacctccgagagcacagcggccctgggctgcctggtcaaggactacttcctatatactgtctgagcgcgggctggcaagcgcatag

SEQ ID NO: 790227 - DNA, 713 bp, Homo sapiens
  misc_feature: 8823.44.73.G07.1.pb.heavy.1.raw 8823
cgtatcgcctccctcgcgccatcagacagtatatacacgaccggtgctcgatttagctctacgctcaggggagctctgggagagggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtctggggaggcgtggtccagcctgggaggtccctgagactctcctgtgaagcctctggatttagtttcagtagttctggcatgcactgggtccgccaggctccaggcaaggggcccgagtggttggcagttatagcatatgatgggaacttctagatattatgcagactccgtgaagggccgattcaccatctcccagagacaattcccggaacactctgtacctggaaatgatcagcctgagaggcgaggactcgctctgtattactgtgcgagatcgggaagtggcagcagctattatccgggccgtttcaactggggccaggggacactggtcaaccgtctctcaggcgcctccaccaagggcccatcggtcttccctggcgccctgctccaggagcacctccgagagcacagccggcccctgggctggcctggtcaaggactacttcctatatactgtctgagcgggctggcaaggcgcatag

SEQ ID NO: 790228 - DNA, 659 bp, Homo sapiens
  misc_feature: 8846.UNK.UNK.UNK.pb.heavy.1.raw 8846
ccgctcagacagtatataggaagtagtccttgaccaggcagcccagggccgctgtggccccagaggtgctcttgaggaggtggccaggggggaagaccgatgggccccttggtggagggctgaggagacggtgaccagggttcccctggccccagtggtcaaagtagttggtgacgaactgccctaactctcgcacagtaatacacgacgccgtgccgcggcgcggtcacagagccagcttcagggagaactggtctcgtggcgtgtcactgatatggtgactcgactcttgagggacgggttgtagtaggtgcctccccactataaatagatactcccaatccactccagccccttccctggggctgggcggatccagccccagtagtaactactactgctgatggagccaccagagacgtgcaggtgagggacagggtctccgaaggcttcaccagtcctgggcccgactcctgcagcctgcagctgggacaggacccatctgggagccgccaccagcaggaggagaaccacaggtgcttcatgttcttgcacaggaggtccatgactctcagaaagcccccgcggaatctacactactaaatcgagcacccggtcgtggtatatactgtctgatggccgccgagggaggcgatacg

SEQ ID NO: 790229 - DNA, 726 bp, Homo sapiens
  misc_feature: 8851.44.62.F07.1.pb.heavy.1.raw 8851
cgtatcgcctccctcgcgccatcagacagtatatacacgaccggtgctcgattttagtagtcgcataaagggaaaggggagctctgagagaggagcccaagccctggatttttcaggtgtcttcatttggtgaccaggaccgaacagagagaagtctccatggagtttgggctgagctgcctttttcttgtggctttttttaaagggtgtcgttgtgtgaagtgcagttgttggagtctgggggggcctgattcggcctgggaggtccctgaccctctctcctgttgcggcctctggattcacctttagtgcctatggcatgacctgggtccgccgggctccaggggagggactggagtgggtctcaagtatcggagctggtggtgtcactttctacggagactccgtgaagggccgcttcaccatttccagggacaattcgcaggacaaaatttgtttctccaaaatgaaaaacctgagacccgaaggacacaggcgtctattactgtttgaaagccaggaccacggtgaccccccatgacacctttagtacttggggcgggggacaggggggtgaccgtctcttcagcctccaccaggggcccatcggtcttcccctggcgccctgctccaggagcacctccgagagcaccagcggcctggctgcctggtcaaggactacttcctaaatatacctgtcctgagcgggctggcaagggcgcatag

SEQ ID NO: 790230 - DNA, 667 bp, Homo sapiens
  misc_feature: 8861.UNK.UNK.UNK.pb.heavy.1.raw 8861
cgccttgccagcccgctcagacagtaataggaagtagtcctttgaccaggcagcccagggccgctgtgctctcggaggtgctcctggagcagggcgccaggggaaagaccgatgggcccttggtggaggctgaggagacggtgaccagggttcctggcccgaatgaaaccatcccagacagtaatagacggctgtgtcctcggtgtcaggctgttcatctgcagagacaccgtatcttttgaatcatctcttgagatggtgaatctgcctttcacgggtgcagcgtagtctgctgtcccaccgtcagctttggttctaatacggccaacccactccagcccttccctggagcctggcggacccaggtcatccaggcgttactgaagtgaatccagaggctgcacaggagagtctaagggactccccaggctttaccaacctcccccagactccaccaactgcacctcacactggacacttttaaaatagcagcaaggaaaatccagctcagcccaaaactccatggtgagtcctctgtgttcagtcctgatcactgaatgaaaacacctggaatcccaaggctgggctcctctccagagctcaacacactctctctaaatcgagcaccggtcggtatatactgtctgatggcgcgaggagcgatacg

SEQ ID NO: 790231 - DNA, 615 bp, Homo sapiens
  misc_feature: 8869.44.23.C01.1.pb.heavy.1.raw 8869
ctatgcgccttgccagcccgctcagacagtatataggaagtagtccttgaccaggcagccagggccgctgtgccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactctgagggacggagagtagtacgtcgccccagtataatggatgtcaccaatccactccattcccctccctggggctgccggatccagccccaagaatgatcagaactgatggaaactccagagacagtgcagatgagagacagggttcccgaaggcctcaccagtcctggcccgactcctgcagctgcacctgggacaggacccatctgggagctgccaccagcaggaggaaaaaccacaggtgttcaccctgcccaatccctaatcacgtgtactaaatcgagcaccggtcgtgtatatactgtctgatggcgcgagggaggcgatacg

SEQ ID NO: 790232 - DNA, 654 bp, Homo sapiens
  misc_feature: 8902.44.53.E09.1.pb.heavy.1.raw 8902
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggatgaggagacggtgaccgtggtcccttggccccagacgtcccaagcgtagtagaattgagacgacctgccataggcggacccatgtctgacacagtagtagacagccgtgtcggcggcggccacagaactcactttcagggaaaactgtgtcctcgacgtgtccacggatatggtgactcgaccgttgagggacgggttgtagtaggtgttcccactataatagagactcccaatccactgcagcccctctcctgggggctggcggatccagccccagtagaaattacttctgtcgatggaggcaccagagaccgtgcacgtgagggacagggtctccgaaggcttcaccagtcctgggcccgactcccgcagctgcggctgagacaggacccatctgggagccgccaccagcaggaggaagaaccacaggtgcttcccccaaacccaacacactctctctaaatcgagcaccggtcgtgtatatactgtctgatggcgcgagggaggcgatac

SEQ ID NO: 790233 - DNA, 701 bp, Homo sapiens
  misc_feature: 8914.44.62.F07.1.pb.heavy.1.raw 8914
ctatgcgccttgccagcccgctcagacagtatataggaagtagtccttgaccaggcagcccagggccgctgtgctctcgaggtgctcctggagcagggcgccaggggaagaccgatgggcccttggtggaggctgaagagacggtcaccactgtcccggcccccaagtactaaaggtgtcatgggggtcaccgtggtcctggctttcaaacagtaatagacgcctgtgtctcgggtctcaggtttttcatttggagaaacaatttgtcctgcgaattgtccctggaaatgtgaagcggcccttcacggagtctccgtagaaaagtgacaccaccagctccgatacttgagacccactccagtcccctccctggagcccgcggacccaggtcatgcataggcactaaggtgaatccagaggccgcacaggagagggtcagggacctcccaggccgaatcaggccccccccagactccaacaactgcacttcaccacgacaccctttaaaaaagccacaagaaaggcagctcagcccaaactccatggagacttctctctgttcggtcctggtcaccaaatgaagacacctgaaaatcccagggctgggctcctctctcagagctcccctttccctttatgcgactactaaatcgagcaccggtcgtgtatatactgtctgatggcgcgagggaggcgatacg

SEQ ID NO: 790234 - DNA, 692 bp, Homo sapiens
  misc_feature: 8918.44.55.E11.1.pb.heavy.1.raw 8918
cgtatcgcctccctcgcgccatcagacagtatatacacgaccggtgctcgatttagcactcgcacgttgggttgggggggagaggagccagcactggattccgaggtgtttccattcggtgatcagcactgaacacagaggactcaccatggagttttggctgagctgggttctccttgtggacttttaaaggtgtccagtgtgaggtgcggctgatggagtctggaggaggctagtccagcctggggggtcccagagactctcctggcagcctctgggctcccgtcagcagcaactacatgagttgggtccgccaggctccagggaaggggctggagtgggtctcagtcatttatactggtgatttcacatactacgcagactccgtgaagggcgattcaccatctccagggacaattccaggacacggtttatcttcaatgaacaacctgagaggcgacgacacggccgtctattactgtgcgagacaagtcggcgctcggagtggttattattcgtttgacttctgggccagggaaccctggtcaccgtcgcctccgcctccaccaagggcccatcggtcttccccctggcaccctcctccaagagcacctctggggcacagcggccctgggctgcctggtcaaggactacttcctatatactgtctgagcgggctggcaggcgcatag

SEQ ID NO: 790235 - DNA, 608 bp, Homo sapiens
  misc_feature: 8927.44.23.C01.1.pb.heavy.1.raw 8927
ctatgcgccttgccagcccgctcagacagtatataggaagtagtccttgaccaggcagcccagggccgctgtgcccccagaggtgctcctggaggcaggggcgccagggggaagaccgatggccttggtggaagctgaggagacagtgaccagggtgccacggccccatagattgaaagaccagtctcgcctcgcacagaaataaacggccgtgtcgcggcggtcacggaggtcagtttcaggagagcggttcatggacgtgtccctcgaaatggtgagacgactttgaggacggagagtagtacgtcgcccagtataatggatgtcaccaatccactccattccccccctgggggctgccggatccagccccagaatgatcagaactgatggaactccagagacagtgcagatgagagacagggttcccgaaggcctcaccagtcctgggcccgactcctgcagctgcacctgggacagaccatctgggagcgccaccagcaggaggaaaaaaccacaggttcaccctgccccaatccctaatcacgtgtactaaatcgagcaccggtcgtggtatatactgtctgatggcgcgaggaggcgatacg

SEQ ID NO: 790236 - DNA, 736 bp, Homo sapiens
  misc_feature: 8933.UNK.UNK.UNK.pb.heavy.1.raw 8933
ctatgcgccttgccagcccgctcagacagtatataggaagtagtccttgaccagggcagcccagggccgctgtgccccagaggtgctcctggagcagggcgccaggggaaggaccgatgggcccttggtggaagctgaagagacggtgaccattgtccccctggccccaaatatcaaatgcatcgacgtcccaggacgcctggcgcagtagatagacgcctgtgtcgtcgggtctcaggttgctcatttgtaaatggccaacactgttgggagtcatcccttgagacggtgaatcttcccttcacagacgcggcgtactctttacttcccaccataacgttcattctgacgaaagtgatccactcaagccccttccctggagactgacggacccaggccaagtgataatcactaagactgaatcctgagactacacaggagagtctcagagaccgccctggctgtgccaagccccccccgactccgccagtcgcccctcgcaactggacaccttctaaaaaaactacaggaaaatcaagattagcccaaactccatggttggtgggtctgtgctcagtgcggatcaccaagtggaaactcctggaatctcacggctggggctcctctcccagagctcccctttgtgtgttcgacgttctgctcttaatcgattgccaccggcgttctttgtatatactcggtccctgatggtttctgctgatcgggaggcgatacg

SEQ ID NO: 790237 - DNA, 684 bp, Homo sapiens
  misc_feature: 8936.UNK.UNK.UNK.pb.heavy.1.raw 8936
gagagactgacaagcgtatcgcctcctcgcgccatcagacagatataacgaccggtggctcgatttagtatctgatagtttgggtttggggggaagaggaagactgacggtctcccaggagttcaggtgctgggcaccttgggcacgggggaggtgtgtcacagatttgggctctggcacccggtgggcatgggggaggcttagttcagcctggggggtccctgagactctcctgtgcagctctggatcaccttcagtagtactggatgccactgggtccgccaagctccagggaagggctggtgtgggtctcacgtattaatagtgatggagtagcacaagctacgcggactccgtgaaggggccgattcaccatctccagagacaacgccaagaacacgctgtatctgcaaatgaacagtctgagagccgaggacccacggctgtgtattactgtgcaagagccggtgcgggagttcggggagttgccatactactactacggtatggacgtctggggccaagggaccacggtcaccgtctcctcagcttccaccaaagggcccatcggtcttccccctggcgccctgctccaggagcacctctggggggcacagcggccctggctgcctggtcaaggactacttcctatatactgtctgagcgggctggcaaggcgcatag

SEQ ID NO: 790238 - DNA, 712 bp, Homo sapiens
  misc_feature: 8942.UNK.UNK.UNK.pb.heavy.1.raw 8942
ctatgcgccttgccagcccgctcagacagtatataggaaaagtagtccttgaccaggcagccagggccgctgtgccccagaggtgctcttggaggagggtgccagggggaagaccgatgggcccttggtggaggcggagcgacggtgaccagggttccctggcccagaagtcaaacgaataataaccactccgagcgccgacttgtctcgcacagtaatagacggccggtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaaactcatgtagttgctgctgaccggtgagccccagaggctgcacaggagagtctctggggacccccccaggctgggactaagcctcctccagactccatcagccgcacctcacactggacaccttttaaaaagtccaacaaggagaaacccagctcagccaaaactccatggtgagtcctctgtgttcagtgctgatcaccgaatggaaaacacctcggaatccagtgctgggctcctctccccaaacccaacgttgcgagtgctaaatcgagcaccggtcgtgtatatactgtcttgatggcgcgagggaggcgatacg

SEQ ID NO: 790239 - DNA, 731 bp, Homo sapiens
  misc_feature: 8945.44.86.H09.1.pb.heavy.1.raw 8945
ctatgcgccttgccagcccgctcagacagtatataggaagtagtccttgaccagccagcccagggccgctgtgccccagaggtgctcttggaggagggtgccagggggaagaccgatgggcccttggtggaggctgaggagacggcgaccgtggtccctttggcccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcctttgcctggagcctggcggacccagtgcatgccatgtctgttgaaggtgaatccagacgctacacaggagagtctcagggacctccaggctggaccacgcctcccccagactccaccagcttcacctgacactggacacctcttaaaagagcaacgaggaaaacccagtcagcccaactccatggtgagtcctctgtgttcggtgctgatcaccgactggaaacaccgccgacttctggtgctggctcctctcccagagctccccaacccaagtctatagcactaaaatcgagcaccggtcgtgtatataaactactgatctgatggcgcgagggaggcgatacg

SEQ ID NO: 790240 - DNA, 602 bp, Homo sapiens
  misc_feature: 8958.UNK.UNK.UNK.pb.heavy.1.raw 8958
acccgacacgcttgctagggacttggagctaaggacgacatattgcctttagacagtcgaaggtgacgccttagctaccactgaacgtttaggcgccagatgcggtctggatgacctaactcgcagcttatcgatgatctactgcccacgctcaaccaaccagggtcttgatgcgcgcgatagactgacggatcgctacagacatttaactcgctagtaacttaatgagatcctaggggatggataggaaatagaatccacccctatcaccccccacatagcctgcttggggtgttgagtttacttttatttcgtgttggaatgagttgaacttcgggaagtggagtaatgggtttggtctacttcccctaaccgcaagtactgttttacagtgagtgcataatagccagtcacaggtaataaacaattcaacgttggcgtaaagattggccgcttgctgtggcattgcaagctgggtttggcagcattgtgcatgcagacgagcaatatgaagtctgcgggaccccctagtggccaaagatgggcgctagcggcttccgcagcttttgacctggaccagggtgcatagcctgccagccttc

SEQ ID NO: 790241 - DNA, 692 bp, Homo sapiens
  misc_feature: 8989.UNK.UNK.UNK.pb.heavy.1.raw 8989
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctgaccccagtagtcaatgagccacccagcgcctcccgcacaataatacacagccgtgtcctcgactctcagactgttcatttgcagatacagtgagttcttggcgttgtctctggagatggtgaatcggcccttcacagagtccacatagtgtgtctcagttccatctttcttcatgatggccacccactccagcccttccctggagcctggcggacccagttcatccaataactactaaaggtgaatccagaggctgcacaggagagtctcagggaccccccaggctggaccaagcctcccccagactccaccagttgcacctcacactggacaccttctaaaatagcaacaaggaaaacccagctcagtcccaattccatggtgagtcctctgtgctcagtgctgatcaccaagtggaaggccttggagtccagggctaaggctcctctctcccctttcccttgcagtcgtagcctaaatcgagcaccggtcgtgtatatactgtctgatggcgcgagggaggcgatacg

SEQ ID NO: 790242 - DNA, 663 bp, Homo sapiens
  misc_feature: 9012.UNK.UNK.UNK.pb.heavy.1.raw 9012
ctatgcgccttgccagcccgctcagacagtatataggaagtagtccttgaccaggcagcccagggccgctgtgcccccagaggtgctcttggaggagggtgccagggggaagaccgatgggcccttggtggaggctgagagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctcccactataatagatactcccaatcactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacccatctgggagccgccaccagcaggaggaagaaccacaggtgcttcatgttcttgcacaggaggtccatgactctcagaaagccccgcggaatctacactactaaatcgagcacccggtcgtgtatatactgtctgatggcgcgagggaggcgatacg

SEQ ID NO: 790243 - DNA, 715 bp, Homo sapiens
  misc_feature: 9020.44.85.H08.1.pb.heavy.1.raw 9020
ctatgcgcttgccagcccgctcagacagtatataggaagtagtccttgaccaggcagcccaggccgctgtgcccccagaggtgctcttggaggagggtgccaggggaagaccgatgggcccttggtggaggctgaggagacggtgaccgtggtcccttggcccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacgagtctgcatagtatttattacttccatcataccatataagtgccacccactccagccccttgcctggagcctggcggacccagtgcatgccataggtactgaaggtgaatccagacgctgcacaggagagtctcaggacctcccaggctgaccacgcctcccccagactccaccagctgcacctgacactggacacctcttaaaagagcaacgaggaaacccagctcaggcccaaactccatggtgagtctctgtgttcagtgttgatcaccgaaatggaaacaccgccgacttctagtgctgggctcctctcccagagctccccgcgactgagtgatactaatcgagcaccggtcgtgtatatactgtctgatggcgcgagggaggcgatacg

SEQ ID NO: 790244 - DNA, 590 bp, Homo sapiens
  misc_feature: 9026.UNK.UNK.UNK.pb.heavy.1.raw 9026
aggctggggcagggctatgcacctggtccagtcaaaagctgcggaacccgctagcggccatcttggccactaggggtccgcagattcatattgtcgtctagcatgcacaatgctgcaaaccagcttgcaatgcccacagcaagcggccatctttacgccacgttgaattgtttattactgtgactggctatggcttgcaaacgccactcgtaaaactagtactttgcgttaggggaagtagacaaacccattactccacttcccggaagttcaactcatttccaacacgaataaagtaaactcaacacccaagcaggctatgtggggtatagggtggattctatttcctatcccatccctaggatctcaattaagttactagcgagttaaatgtctgtagcgatcccgtcagtcctatcgcgcgcatcaagacctggttggttgagcgtgcagtagatcatcgataagctgcgagttaggtcatccgaccgcatctggcgcctaacgttcagtggtagctaaggcgtcccttcgactgtctaaaggcaaatatgtccgtccttagctccaagtcctagcaagcgtgtcgg

SEQ ID NO: 790245 - DNA, 752 bp, Homo sapiens
  misc_feature: 9043.UNK.UNK.UNK.pb.heavy.1.raw 9043
ctatgcgccttgccagccgctcaggacagtatataggaaggtcagtccttgaccaggcagcccagggcccgctgtgcccccagaggtgctcttggagggagggtgcgcagggggaagaccgatgggcccttggtggaggctgaggagacggcgaccgtggtcccttggccccaggcgtccataccattggagtagagcatgtcatatctgtatccacgagcccccatctctcgcacagtagtagacagccgtgtcctcggctctcaggctattcatttccaggatatagtgtgttcttcgaattgtctctgggagatggtgaatcggccccttcacggaatctacataatatttattacttccatcataccatataagtgccacccactccagtccctttgcctggagccctgggccggacccagtgcatgccatgtctgttgaaggtgaatccagacgctacacaggagagtctcagggaacctcccaggctggaccacgcctcccccagactccaccagcttcacctgacactggacacctcttaaaagagcaacgaggaaaacccaggtcagcccaaactccatggtggagtcctctgtgttcgggtgctgatcacccgactggaaacaccgccgacttctggtgcctgggctcctcctcccagagctccccaaacccaacgaggctcactctaaatcgagcaccggtcgtgtaatatactgtctgatggcgcggagggaggcgatacg

SEQ ID NO: 790246 - DNA, 664 bp, Homo sapiens
  misc_feature: 9046.44.12.B01.1.pb.heavy.1.raw 9046
cgtatcgcctccctcgcgccatcagacagtatatacacgaccggtgctcgatttagtagtgtagattccgcgggggctttctgagagtcatggacctcctgtgcaagaacatgaagcacctgtggttcttctcctgctggtggcggctcccagatgggtcctgtccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtcccctcaagagtcgagtcaccatatcagtagaccgtccaagaaccagttctccctgaagctgagctctgtgaccgccgcggacacggccgtgtattactgtgcgagagtagggcagttcgtcaccaactactttgaccactgggggccagggaaccctggtcaccgtctcctcagcctccaccaaggggcccatcgtcttccccctggcaccctcctccaagagcacctctgggggcacagcggccctgggctgcctggtcaaggactacttcctatatactgtctgagcgggctggcaaggcgcatag

SEQ ID NO: 790247 - DNA, 677 bp, Homo sapiens
  misc_feature: 9059.44.6.A06.1.pb.heavy.1.raw 9059
cgtatcgcctccctcgcgccatcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctcttttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcaattgtcacctcagctttccaccaagggcccatcggtcttccccctggcgccctgctccaggagcacctctgggggcacagcggccctggctgcctggtcaaggactacttcctatatactgtctgagcgggctggcaaggcgcatag

SEQ ID NO: 790248 - DNA, 727 bp, Homo sapiens
  misc_feature: 9061.44.85.H08.1.pb.heavy.1.raw 9061
ctatgcgccttgccagcccgctcagacagtatataggaagtagtccttgaccaggcagcccagggccgctgtgcccccaagaggtgctcttggaggagggtgccagggggaagaccgatgggcccttggtggaggctgaggagacggtgaccgtggtcccttggccccagacgtccataccgtagtagtagtccagcggtggtagtactacaatatgtcctcgcacagtaatacacagcgtggtcctcggctctcaggctgttcatttgcagatacaggcgtgttcttggaattgtctctggagatgcgtgaatcggccccttcacggagtctgcatagtattttattacttccatcataccatataagtgccacccactccagcccttgcctggagcctggcggacccagtgcatgcccataggtactgaaggtgaatccagacgctgcacaggagagtctcagggacctcccaggctggaccacgcctcccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggctcctctcccagagctccccgcgactgagtgatactaaatcgagcaccggtcgtggtatatactgtctgatggcgcgagggaggcgatacg

SEQ ID NO: 790249 - DNA, 647 bp, Homo sapiens
  misc_feature: 9072.UNK.UNK.UNK.pb.heavy.1.raw 9072
ctatgcgccttgccagccgcgctcagacagtatataggaagtagtccttggaccaggcagcccagggccgctgtgccccagaggtgctcttggaggagggtgccaggggaagaccgatgggcccttggtggaggctgaggagacggtgaccagggttccctggccccagtggtcaaagtagttggtgacgaactgccctactctcgcacagtaatacacggccgtgtcgcggcggtcacagagcttcagcttcagggagaactggttcttggacgtgtctactgatatggtgactcgactctttgagggacgggttgtagtaggtgctcccactataatagatactcccaatccactccagccccttccctgggggctggcggatccagccccagtagtaactactactgctgatggagccacccagagacagtgccaggtgagggacagggtctccgaaggcttcaccagtcctgggccgacctgcgctgcgctgggacaggacccatctgggagccgccacccaagcagggaggcgccatgcattttcttgcacaggaggtccatgtcttccgaagccccgcggatctactactaaatcgagcaccgtgcgtgtatatactgttgatggcgggggaggcgatacg

SEQ ID NO: 790250 - DNA, 577 bp, Homo sapiens
  misc_feature: 9078.UNK.UNK.UNK.pb.heavy.1.raw 9078
cgtatcgcctccctcgcgccatcagaccagtatatacaacgaccggtgctcgatttagtgtgagtagttgggtttgggtgccgaagttgctggagggtcacggtcaccacgctgctgaggtgaagaagcctgggcctcagtgacagtctcctgcacggcttctggatacacgttcatcaatatgatattaactgggtgcgacaggccgctggacaagggctggagtggatggggatggatgaaagccctatagtggcaacacgggctttgccccagaagttccaaggcagagttagtatgaccaggagcacctccccaggtacagtctacatggaaactgagcagcctgagatctgagggacacggcgtgtatttctgtgcgagagccaccagcacctggcttgacttgtggggccagggaaccctggtcaccgtctcctcagcctcccccaagggcccatcggtcttcccctggcgccctgctccaggagcacctccgagagcacagcggccctggggctgcctggtcaaggactacttcctatatacggtctgagcgggctggcaaggcgcatag

SEQ ID NO: 790251 - DNA, 693 bp, Homo sapiens
  misc_feature: 9088.44.36.D03.1.pb.heavy.1.raw 9088
ctatgcgccttgccagccgctcagacagtatataggaagtagtccttgaccaggcagccaggccgctgtgctctcggaggtgctcctggagcagggcgccagggggaagaccgatgggcccttggtggaggctgaggagacggtgaccaggttccctggcccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggcagccactccagccccttccctggagcctggcggaccagtccatatagtggtcactgatggtgaatcagaggcgacacaggagagtctcaggaccctccaggctggaccaagtctcccccggactccaccaactgcacttcactctggacaccttgtaaaataacaacaaggaaaacccagctcagcccgaactccatggtgagtcctctgtgttcagtggctgatcaccaatgaaaacacctggaattctggggctgggctccgctctcagagctccccaagagagatcgtgacgcagctaaatcgagcaccggtcgtgtatatactgtctgatggcgcgagggaggcgatacg

SEQ ID NO: 790252 - DNA, 681 bp, Homo sapiens
  misc_feature: 9123.44.21.B10.1.pb.heavy.1.raw 9123
ctatgcgccttgccagcccgctcagacagtatataggaagtagtccttgaccaggcagccagggccgctgtgctctcgaggtgctcctggagcagggcgccaggggaagaccgatgggcccttggtggaggctgaggagacggtgaccagggttccctggccccagtggacagttcctgatataaacacaacacaataatacatgccgtgtcctcggtttcaggttagtcattcgcagaatcaatgagttcttgaagtcatctcttgagagggtgaatctggctttcacagacgcggcgtactctgtgataaagctggcaactttgtttttactgcggccaagccactccagctccttcctggaggcctggcgacccagtccatatagtggtcactgatggtgaatccagaggcgacacaggagagtctcagggaccctccaggctggaccaagtctccccggactccaccaactgcacttcactctggacaccttgtaaaataacaacaagaaaacccagctcagcccgaactccatggtgagtcctctgtgttcagtgctgatcaccaaatgaaaacacctgggaattctggggctggggctccgctctctcttgcgacgacactaaatcgagcaccggtcgtgtatatactgtctgatggcgcgagggaggcgatacg

SEQ ID NO: 790253 - DNA, 698 bp, Homo sapiens
  misc_feature: 9160.44.67.G01.1.pb.heavy.1.raw 9160
cgtatcgcctccctcgcgccatcagacagtatatacacgaccggtgctcgatttagagtatacatattgggtttggggggagaggagccagcactgggattccgaggtgtttccattcggtgatcagcactgaacacagaggactcaccatggagttttggctgagctgggttctccttgttgacttttaaaaggtgtccagtgtgaggtgcggctgatggagtctggaggaggcttagtccagcctggggggtccagagactctcctgtgcagcctctgggctcaccgtcagcagcaactacatgagttgggtccgccagctccagggaagggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccagggcccatcggtcttcccctggcaccctcctccaagagcacctctgggggcacagcggccctgggctgcctggtcaaggactacttcctatatactgtctgagcgggctggcaaggcgcatag

SEQ ID NO: 790254 - DNA, 544 bp, Homo sapiens
  misc_feature: 9166.44.43.D10.1.pb.heavy.1.raw 9166
cgtatcgcctccctcgccgcatcagacagtatatacacgaccggtgctcgattttagactagcagtaaggggctgaggtgaaagaagcctggggcctcagtgaaggttctcctgcaaggctctgatacaccttcaccaattatgatatcaactgggtgcgacagccactggacaagggcttgagtggatggatggatgaaccctaacagtggtaacacaggctatgcacagaagttccagggcagagtcaccatgaccaggaacacctccataaacacagcctacatgagctgagcagcctgagatctgaggacacggccgtgtattactgtgcgagatcccgaaagtatagcagctcgtcggggaggtggtcgacccctgggccagggaacctggtcaccgtctcctcagcttccaccaagggcccatcgcgtctccccctggcgccctgctccaggagccctctgggggcacagcggccctgggctgcctggtcaaggactacttcctatatactgtctgagcgggctggcaaggcgcatag

SEQ ID NO: 790255 - DNA, 704 bp, Homo sapiens
  misc_feature: 9182.UNK.UNK.UNK.pb.heavy.1.raw 9182
cgtatcgcctccctcgcgccatcagacagtatatacacgaccggtgctccgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctggggctcaccgtcagcagcaactacatgagttgggtcgccaggctccagggaaggggctggagtgggtctcagtcatttatactggtgatttcacatactacgcagactccgtgaaggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 790256 - DNA, 700 bp, Homo sapiens
  misc_feature: 9191.44.27.C05.1.pb.heavy.1.raw 9191
cgtatcgcctcctcgcgccatcagacagtatatacacgaccggtgctcgattttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtgagtctggggagcgtggcccagtaggggggtccctgagactctcctgtgcagcctctggattcaccttcgataattggaatatgcagtgggtccgccaggctccaggcgaggggctggagtgggtggcagtgtgtcatttcatggagaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaaatcggttcattcgacgcctgggccagggaaccctggtcaccgtctcctcggcctccaccaagggcccatcggtcttccccctggcgccctgctcaggagcacctccgagagcacagcggccctgggctgcctggtcaaggactacttcctatatactgtctgagcgggctggcaaggcgcatag

SEQ ID NO: 790257 - DNA, 666 bp, Homo sapiens
  misc_feature: 9244.UNK.UNK.UNK.pb.heavy.1.raw 9244
tatagaagtagtccttgaccaggcagcccaggccgctgtgccccagaggtgctcttggaggagggtgccagggggaagaccgatgggcccttggtggaggcggaggcgacggtgaccagggttccctggccccagaagtcaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaataccagtataaatgactgagacccactccagccccttcctggagcctggcgacccaactcatgtagttgctgctgacggtgagcccagaggctgcacaggagagtctctggacccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatccagtgctgggctcctctcccccccaaacccaacgtgcgagtgctaaatcgagcaccgtcgtgtatatactgtctgatggcgcgagggaggcgatacg

SEQ ID NO: 790258 - DNA, 713 bp, Homo sapiens
  misc_feature: 9245.UNK.UNK.UNK.pb.heavy.1.raw 9245
ctatgcgccttgccagcccgctcagacagtatataggaagtagtccttgaccagcagccgccaggccgctgtgctctcggaaggtgctcctggagcagccgccaggggaagaccgatggcccttggtgagctgaggagagacggtgaccagggttccctggccccagtggacaggttcctgatataaacacaacacaataatacatgcccttgtcctcggtttcaggttagtcattcgcagaatcaatgagttcttgaagtcatctctgagagggtgaatctggcttcaacagacgcggcgtactctgtgataaagctggcaactttgttttactgcggccagccactccagccccttccctggagcctgcgcggacccagtccatatagtggtcactgatggtgatccagaggcgacacaggagagtctcagggaccctccaggctggacaagtctcccccggactcccccaactgcacttcactctggacaccttgtaaaatacacaaggaaaccccagcttcagcccgaactccatggtgagtcctctgtgttcagtgctgatcacccaaatgaaaaaacactgggaatctggggctgggctccgctcttcagagctcccaagagagatcgtgacgcagctaaatcggagcgcacgcggttcgtggtgatatatactgttctgatggcgcgaggcgagaggcgataaacg

SEQ ID NO: 790259 - DNA, 703 bp, Homo sapiens
  misc_feature: 9247.UNK.UNK.UNK.pb.heavy.1.raw 9247
ctatgcgccttgccaggcccgctcagacagtatataggaagtagtccttgaccaggccagcccagggccgctgtgctctcggaggtgctcctggaggcaggcgccaggggaagaccgatgggccccttggtggaggctgaggagacggtgaccaggttccctggccccgaatgaaaccatcccagacagtaatagacggctgtgtcctcggtgtttcaggctgttcatctgcagagacaccgtatcttttgaatcatctctttgagatggtgaatctgcctttcacgggtggcagcgtagtctgctgtcccaccgtcagctttggttctaatacggccaacccactccagcccttccctggaggcctggcgcgacccaggtcatccaggcgttactgaaagtgaatccagaggctgcacaggagagtctaagggactccccaggctttaccaaacctcccccagactccaccaactgcacgctcacactggacaccttttaaaatagccagcaaggaaaatccagctcagcccaaactccatggtgagtcttcctgtgtttcagtcctgatcactgaatgaaaacacctgggaatcccaaggctgggccgcctctctccagagctcaacacactctctctaaatcgagcacccggtgcgtgtatatactgtctgatggctgacgaggggagtgaggcgatacg

SEQ ID NO: 790260 - DNA, 695 bp, Homo sapiens
  misc_feature: 9255.UNK.UNK.UNK.pb.heavy.1.raw 9255
ctatgcgccttgccagcccgctcagacagtatataggaagtagtccttgaccaggcagcccagggccgctgtgccccagaggtgctcttgaggagggtgccaggggaagaccgatgggcccttggtgaggcggaggcgacggtgaccagggtttccctggccccagaagtcaaacgaataataaccactccgagcgccgacttgtctcgcacagtaatagacggccgtgtcgtcgcctctcaggttgttcatttgaagataaaccgtgttcctggaatgtccctggagatggtgaatcggccccttcacggagtctgcgtagtatgtgaaatcaccagtataaatgactgagacccactccagcccttccctggagcctggcggaccccaactcatgtagttgctgctgacggtgagcccagaggctgcacaggagagtctctgggaccccccaggctggactaagcctcctccagactccatcagccgcacctcacactggacacctttaaaagtccaacaaggagaacccagctcagccaaaactccatggtgagtcctctgtgttcagtgctgatcaccgaatggaaacacctccggaatccagtgctggctcctctcccaaacccaacgtgcgagtgctaaatcgagcacggtcgtgtatatactgtctgatggcgcgaggaggcgatacg

SEQ ID NO: 790261 - DNA, 699 bp, Homo sapiens
  misc_feature: 9275.44.36.D03.1.pb.heavy.1.raw 9275
cgtatcgcctccctcgcgccatcagacagtatatacacgaccggtgctcgatttagctgcgtcacgatctctcttggggagctctgagagcggagcccagcccagaattcccaggtgttttcatttggtgatcagcactgaacacagaggactcaccatggagttcgggctgagctgggttttccttgttgttattttacaagtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcacctctcaagagatgacttcaagaactcattgattctgcgaatgactaacctgaaaaccgaggacacgggcatgtattattgtgttgtgttatatcaggaactgtccactggggccagggaaccctggtcaccgtctcctcagcctccaccaagggccatcggtcttccccctggcgccctgctccaggagcacctccgagagcacagcggccctgggctgcctggtcaaggactacttcctatatactgtctgagcgggctggcaaggcgcatag

SEQ ID NO: 790262 - DNA, 540 bp, Homo sapiens
  misc_feature: 9277.UNK.UNK.UNK.pb.heavy.1.raw 9277
ctatgcgcctgccagccgctcagacagtatataggaagtagtccttgaccaggcagcccaggccgctgtgccccagaggtgctcctggagcaggcgccaggggaagaccgatgggcccttggtggaagctgaggagacggtgaccgtggtcccttggccccagacgtccataccgtagtagtagtatgcaactccccgaactcccgcaccggctcttgcacagtaatacacagccgtgtctcggctctcagactgttcatttgcagatacagcgtgttcttggcgttgtctctggagatggtgaatcggcccttcacggagtccgcgtagctgtgctcccatcactacttaatacgtgagaccacaccagcccttcctggagcttggcggacgccagtgcatccagtagcctacctgaaggtgaatccagaggcctgcacaggagaagtcttcagggacccccccaggctgaactatcagatacaaatcgagcacgcgtcgtgtatatactgtctgatggcgcgagggaggggcgatacg

SEQ ID NO: 790263 - DNA, 657 bp, Homo sapiens
  misc_feature: 9292.44.70.G04.1.pb.heavy.1.raw 9292
cgtatcgcctcctcgcgccatcagacagtatatacacgaccggtgctcgatttagtgtagtgtgaagggaaagggggactcctgtgccccaccatggacacactttgctccacgctcctgctgctgacccatcccttcatggggcctgtcccagatcaccccgtgaaagagtctggccctacattggtgaaacccacacagaccctcacgctgacctgcaccgtctcaggcttctcactcgtcactcctggagagggcgttgtctgggtgcggcagccccccggaaaggccctggagtggatcgcactcacttattggaatgaccgatatacgatatagtccttctctgacgaccagactcacgctcacgaaggacacgtccaaaaaaccaggtggtccttacattgaccaacgtggaccctgtggacacaggcacatatttctgtgcccacttcatgaccacaatgaccacgggcttcttcgaaccctggggccagggaatccaggtcaccgtctcatcagcctccaccaagggccccatcggtcttcccccctggcgccctgctccaggagcacctccgagagcacagcggccctgggctgcctggtcaaggactacttcctatatactgtctgagcggctggcaaggcgcatag

SEQ ID NO: 790264 - DNA, 656 bp, Homo sapiens
  misc_feature: 9310.UNK.UNK.UNK.pb.heavy.1.raw 9310
ctatgcgccttgccagcccgctcagacagtatataggaagtagtccttgaccaggcagccaggccgctgtgcccccagaggtgctctggaggagggtgccaggggaagaccgatgggcccttggtggaggctgaggagacggtgaccagggttccctggcccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacccatctgggagccgccaccagcaggagaagaaccacaggtgcttcatgttcttgcacaggaggtccatgactctcagaaagccccgcggaatctacactactaaatcgagcaccgtcgtgtatatactgtctgatggcgcgagggaggcgatacg

SEQ ID NO: 790265 - DNA, 762 bp, Homo sapiens
  misc_feature: 9317.UNK.UNK.UNK.pb.heavy.1.raw 9317
cgtatcgccctccctcggcgccatcagacagtatatacacgacccggtgctccgatttagtgctatagacttgggttggggagctctggagaggaggcccagcaccagaagtcggcggtgtttccagtcggtgatcagcaccgaacacagaggactcaccatgggagttttgggctgacctgggggttttcctcgttgccttttaagaggtgtccagtgtcaggtgaagctggtggagtctggggagggcgtggtccagcctgggaggctccctgagactctcctgtgtagcgtctggattcaccttcaacagacatggcatgcactgggttccgccaggctccagggcaagggactggagtgggtggcacttatatggtatgatggaagtaataaatattattgtagattccgtgaaggggccgattcaccatctcagagacaattcggaagaacacactatatctggaaatgaatagcctgagaagcccgaggacacggctgtctactactgctgtgcgagagatggccggccggtggataacagatatgacaatgctctactccaatggtatggacgcctgggccaagggaccacccggtccgcgtctcctcagcctccaccaagggcccatccggtcttcccccctggcaccctcctccaagagcacttcctgggggcacagcggccctgggctgcctggtcaaggactactctcctatatacttcctgtctgagcggggctggcggcaggcgcatag

SEQ ID NO: 790266 - DNA, 710 bp, Homo sapiens
  misc_feature: 9319.UNK.UNK.UNK.pb.heavy.1.raw 9319
cgtatcgcctccctcgcgccatcagacagtatatacacgacggtgctcgatttagctgcgtcacgatctctcttggggagctctgagagcggagccccagccccagaattcccaggtgttttcatttggtgatcagcacctgaacacaagaggactcaccatggagttcggcctgagctgggttttccttgttgttattttacaaggtgtccagagtgaaggtgcagttggtggagtccggggaaaacttggtccagcctggagggtccctgaactctcctgttcgcctctgattcaccatcagtgaccactatatggactgggtccgccaggccctccagggaaggggctggagtggcttggccgcagtaaaaaacaaagtgccagcttatcacagaagtacgccgccgtctgtgaaagcccagattcaccctctcaagagatgacttcaagaactcatgattctgcgaatgactaacctgaaaaccgaggacacgggcatgtattattgtgttgtgtttatatcaggaactgtccactggggccagggaaccctggtcaccgtctccctcagcctcccaccaagggcccatcggtcttccccctggcgccctgctccaggagcacctccgagagcacagccggccctgggctgcctggtcaaggactacttcctatatactgtctgagcgggctggcaaggcgcatag

SEQ ID NO: 790267 - DNA, 693 bp, Homo sapiens
  misc_feature: 9327.44.72.G06.1.pb.heavy.1.raw 9327
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctgaccccagtagtcaatgagccacccagcgcctcccgcacaataatacacagccgtgtcctcgactctcagactgttcatttgcagatacagtgagttcttggcgttgtctctggagatggtgaatcggccccttcacagagtccacatagtgtgtctcagttccatctttcttcatgatggccacccactccagccccttccctggagcctggcggacccagttcatccaataactactaaaggtgaatccagaggctgcacaggagagtctcagggaccccccaggctggaccaagcctcccccagactccaccagttgcacctcacactggacaccttctaaaatagcaacaaggaaaacccagctcagtcccaattccatggtgagtcctctgtgctcagtgctgatcaccaagtggaaaggccttggagtccagggctaaggctcctctctcccctttcccttgcagtcgtagctaaatcgagcaccggtcgtgtatatacgtctgatggcgcgagggaggcgatacg

SEQ ID NO: 790268 - DNA, 540 bp, Homo sapiens
  misc_feature: 9329.44.27.C05.1.pb.heavy.1.raw 9329
ctatgcgccttgccagcccgctcagacagtatataggaagtagtccttgaccaggcagcccaggccgctgtgctctcgaggtgctcctggagcagggcgccaggggaagaccgatgggcccttggtggaggccgaggagacggtgaccagggttccctggccccaggcgtcgaatgaaccgattttggaaacagatagtctcgcacaaaatacacggccgtgtcctgaggtctcaggctgttcatttgaagagacactgtgttctcggaattgtctctggagatggtgaatcggcctcaacggaatcaccgtagacttgatttcctccatgaaatgacacacctgccacccactccagcccctcgcctggagcctggcggacccactgcatattccaattatcgaaggtgaatccagaggctgcacaggagagtctcaggacccccctactggggccacgcctccccaaacccttcgatcgcgtctaaatcgagcaccggtcgtgtatatactgtctgatggcgcgagggaggcgatacg

SEQ ID NO: 790269 - DNA, 667 bp, Homo sapiens
  misc_feature: 9335.UNK.UNK.UNK.pb.heavy.1.raw 9335
cgtatcgcctccctcgcgccatcagacagtatatacacgacgcggtgctcgatttagtagtgtagattccgcggggctttctgagagtcatggacctcctgtgcaagaacatgaagcactgtggttcttcctcctgctggtggcggctcccagatgggtcctgtcccagctgcagctgcaggagtcgggcccaggactgtgaagccttcggagaccctgtccctcacctgcactgtctctggtgctccatcagccagtagtagttaccctactggggctgatcgccagcccccagggaaggggctggagtggattgggagtatctattatagtgggagcacctactacaacccgtcccttcaagagttcgagtcagccatatcagtagacacgtccaagaaccagttctccctgaagctgagctctgtgaccgccgcggacacggccgtgtattactgtgcgagagtagggcagttcgtcaccaactacttgaccactgggccagggaaacccctggtcaccgtctcctcagcctccaccaagggcccatcggtcttccccctggcaccctcctccaagagcacctctgggggcacagcggccctgggctgcctggtcaaggactactttcctatatactgtctgagcgggctggcaaggcgcatag

SEQ ID NO: 790270 - DNA, 661 bp, Homo sapiens
  misc_feature: 9373.UNK.UNK.UNK.pb.heavy.1.raw 9373
cgtatcgcctccctcgcgccatcagacagtatatacacgaccgtgctcgatttagtagtgtagatttccgcgggggctttctgagagtcatggacctcctgtgcgaagaacatgaagcacctgtggttcttcctcctgctggtggcggctcccagatgggtcctgtcccagctgcagctgcaggagtcgggcccaggactggtgaagccttcggagacctgtccctcacctgcactgtctctggtggctccatcagcagtagtagttactactggggctggatccgccagcccccagggaaggggctggagtggattgggagtatctattatagtggagcacctactacaacccgtccctcaagagtcgagtcaccatatcagtagacacgtcaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttcccctggcaccctcctccaagagcacctctgggggcacagcggccctgggctgcctggtcaaggactacttcctaatactgtctgagcgggctggcaaggcgcatag

SEQ ID NO: 790271 - DNA, 691 bp, Homo sapiens
  misc_feature: 9382.44.36.D03.1.pb.heavy.1.raw 9382
cgtatcgcctccctcgcgccatcagacagtatatacacgaccggtgctcgatttagctgcgtcacgatctctcttggggagagcggagccccagccccagaattcccaggtgttttcatttggtgatcagcactgaacacagaggactcaccatggagttcggctgagctgggttttccttgttgttattttacaaggtgtccagagtgaagtgcagttggtggagtccgggggagacttggtccagcctggagggtccctgagactctcctgtgtcgctctggattcaccatcagtgaccactatatggactgggtccgccaggctccagggaagggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacggcatgtattattgtgttgtgtttatatcaggaactgtccactggggccagggaaccctggtcaccgtctcctcagcctccaccaagggcccatcggtcttcccctggcgccctgctccaggagcacctccgagagcacagcggccctggctgcctggtcaaggactacttcctatatactgtctgagcggctggcaaggcgcatag

SEQ ID NO: 790272 - DNA, 702 bp, Homo sapiens
  misc_feature: 9474.44.55.E11.1.pb.heavy.1.raw 9474
ctatgcgccttgccagcccgctcagacagtatataggaaagtagtccttgaccaggcagcccagggccgctgtgcccccagaggtgcctttggaggagggtgccaggggaagaaccgatgggcccttggtggaggcggaggcgacggtgaccaggttccctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggccttcacggagtctgcgtagtatgtgaaatcaccagtataaatgactgagacccactccagccccttccctggagcctggcgcgacccaactcatgtagttgctgctgacggtgagcccagaggctgcacaggagagtctctgggacccccaggctggactaagcctcctccagactccatcagccgcacctcacactggacaccttttaaaagtccaacaaggagaacccagctcagccaaaactccatggtgagtcctctggtgttcagtgctgatcaccgaatggaaacacctcggaatcccagtgctgggctcctctccccaaacccaacgtgcgagtgctaaatcgagcaccggtcgtgtatatactgtctgatggcgcgagggaggcgatacg

SEQ ID NO: 790273 - DNA, 700 bp, Homo sapiens
  misc_feature: 9492.44.36.D03.1.pb.heavy.1.raw 9492
cgtatcgcctccctcgcgccatcagacagtatatacacgaccggtgctcgatttagctgcgtcacgatctctcttgggggagagcggaggccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790274 - DNA, 705 bp, Homo sapiens
  misc_feature: 9496.44.36.D03.1.pb.heavy.1.raw 9496
cgtatcgcctccctcgcgccatcagacagtatatacacgaccggtgctcgatttagctgcgtcacgatctctcttggggagctctgagagcggagccccagccccagaattcccaggtgtttttcatttgtgatcagcactgaacacagaggactcaccatggagttcgggctgagctgggttttccttgttgttattttacaaggtgtccagagtgaagtgcagttgtggagtcgggggagacttggtccagcctggagggtccctgagactctcctgtgtcgcctctggattcacatcagtgaccactatatggactggggtccgccaggctccagggaaggggcctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggccccatcggtcttcccctggcgccctggctccaggagcacctccgagagcacagcgccctgggctgcctggtcaaggactacttcctatatactgtctgagcggggctggcaaggcgcatag

SEQ ID NO: 790275 - DNA, 698 bp, Homo sapiens
  misc_feature: 9516.UNK.UNK.UNK.pb.heavy.1.raw 9516
cgtatcgcctccctcgcgccatcagacagtatatacaccgaccggtgctcgatttagtgtcgtcgcaagagagaggagccccaggccgtgagattcccaggagtttccacttggtgatcagcactgagcacagaccaccaaccatgggtttgggctaatcttgattttcctttgtagttttttttagaaggtgtccagtgcgaggggcgctggcggagtcgggggggggggggcttggcacagccagggcggtctctgagactctcctgtgtagtctcaggattcagtcttagtgatatcacttggcctggggtccgtcaggctccagggaaggggcttgagtggatcactttcgtcagaatgacgttatggtggaagtaaagagtacgccgcgtctgtgaagggaagttcaccgtctcagggatgactcccaacagtgttggccatttacaatgagcaacctgagacccgacgacacaggcgtctattactgcgcccaggcgatcctgggacgtcgatgcatttgatattgggggccaggggacaatggtcaccgtctcttcagcttccaccaaggggcccatcggtcttcccctggcgccctgctccaggagcacctctggggcacagcggccctgggctgcctggtcaaggactacttcctatatactgtctgagcgggctggcaaggcgcatag

SEQ ID NO: 790276 - DNA, 732 bp, Homo sapiens
  misc_feature: 9525.UNK.UNK.UNK.pb.heavy.1.raw 9525
cgtatcgcctccctcgcgccatcaggacagtatatacacgaccgtggctcgatttagtatcactcagtcgcgggagctctgggagaggagcccatgcactagagtcggcggtgtttccattcggtgatccagcactgaacacagaggactcaccatggaagtttgggggctgagctgggtttttcctcgttgctcttttaagaggtgtccagtgtcaggtgcagctggtggagtctggggaggcgtggtccagcctgggaggtccctgagactctcctgtgcagcgtctggattcaccttcagtacctatggcatgcactgggtccgccaggctccaggcaaggggctggagtgggtggcacttatatggtatgatggaagttaataaatactatgcagaactccgtgaaggggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaagggccccatcggtcttccccctggcaccctcctccaagagcacctctgggggcacagcggccctgggcttgcctggtcaaggactacttcctatatactgtctgagcgggctggcaaggcgcatag

SEQ ID NO: 790277 - DNA, 681 bp, Homo sapiens
  misc_feature: 9535.44.73.G07.1.pb.heavy.1.raw 9535
ctatgcgccttgccagcccgctcagacagtatataggaagtagtccttgaccagcagcccagggccgctgtgctctcggaggtgctcctggagcagggcgccagggggaagaccgatgggccctggtggaggctgaggagacggtgaccagtgtccctggccccagtgaaacggcccgataatagctgctgccacttccgatctcgcacagtaatacagagccgagtcctcgcctctcaggctgatcatttccaggtacagagtgttccgggaattgtctctggagatggtgaatcggcccttcacggagtctgcatgatatctagaagttccatcatatgcataactgccaaccactcggccccttgcctggagcctggcggacccagtgcatgccagaactactgaaactaaatccagaggcttcacaggagagtctcagggacctcccagctggaccacgcctcccccagactccaccaggtgcacctgacactggacacctcttaaaaagagtaacgaggaaaaacccagctcagcccaaactccatggtgagtcctctgtgttcagttgctgatcaccgaatggaacaccgccgagagcacagcggccctgagcgtagagctaaatcgagcaccggtcgtgtatatactgtctgatggcgcgagggaggcgatacg

SEQ ID NO: 790278 - DNA, 604 bp, Homo sapiens
  misc_feature: 9594.UNK.UNK.UNK.pb.heavy.1.raw 9594
gaaggctgggcaggctatgcaccctggtccaggtcaaaagctgcggaacccgctagcggccatcttggccactagggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttagggaagtagacaaacccattactccacttcccggaagttcaactcattccaacacgaaataaaagtaaactcaacaccccaagcaggctatgtggggggtgataggggtggattctatttcctatcccatccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 790279 - DNA, 648 bp, Homo sapiens
  misc_feature: 9596.44.23.C01.1.pb.heavy.1.raw 9596
cgtatcgcctccctcgcgccatcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctctggagtttccatcagttctgatcattcttggggctggatccggcagccccagggagggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggcgtggcaccctggtcactgtctcctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 790280 - DNA, 706 bp, Homo sapiens
  misc_feature: 9604.44.85.H08.1.pb.heavy.1.raw 9604
cgtatcgcctccctcgcgccatcagacagtatatacacgaccggtgctcgatttagtatcactcagtcgcgggagctctgggagaggagccagcactagaagtcgcgtgtttccattcggtgatcagcactgaacacagaggactcaccatggagttgggctgagctgggttttctcgttgctcttttaagaggtgtcagtgtcagggcagctggtggagtctgggggagcgtggtccagcctgggaggtccctgagactctcctgtgcagcgtctggattcaccttcagtacctatggcatgcactgggtccgccaggctccaggcagggctggagtggtggcactatatggtatgatggaagtaataaatactatgcagactccgtgaagggcgattcaccatctccagagacaattccaagaacacgctgtatctgcaaatgaacagcctgagagccgagacacgctgtgtattactgtgcgaggacatattgtagtactaccacctgctgggactactactacggtatggacgtctggggccaagggaccacggtcaccgtctcctcagcctccaccaagggcccatcggtcttcccctggcaccctcctccaagagcacctctgggggcacagcggccctgggctgcctggtcaaggactacttcctatatactgtctgagcgggctggcaaggcgcatag

SEQ ID NO: 790281 - DNA, 704 bp, Homo sapiens
  misc_feature: 9624.44.27.C05.1.pb.heavy.1.raw 9624
cgtatcgcctccctcgcgccatcagacagtaatacacgaccggtgctcgatttagacgcgatcgaagggtttgggcctgggagacgagccagcactggaagtcgccggtgtttccactcggtgatcatcactgaacacagaggactcaccatggagttttgggctgagctgggtttcctcgttgcccctctaagaggtgtcatgtgtcaggggcattcgtggagtctgggggaggcgtggccccagtagggggtccctgagactctcctgtgcagcctctggattcaccttcgataatggaatatgcagtgggtccgccaggctccaggcgagggggctggagtggtgcggcaggtgtgtcatttcatggaggaaatcaagtctacggtgattccgttgagggcccgatcaccatctccagagacaattccggagaacacagtgtctcttcaaatgacagcctgaagacctcaggacacggccgtgtatttttgtgcgagactatctgtttccaaaatcggttcattcgacgcctggggccagggaaccctgggtccaccgtctcctcggcctccaccaaggcccatcggtcttccctggcgccctgctccaggagcacctccgagagcaagcggccctgggctgccctggtcaaggactacttcctatatactgtctgagcgcggctggcaaggccggcatag

SEQ ID NO: 790282 - DNA, 652 bp, Homo sapiens
  misc_feature: 9657.44.23.C01.1.pb.heavy.1.raw 9657
cgtatcgcctccctcgcgccatcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtccaggtgcagctgcaggagtcgggcccaggactggtgaggccttccgggaaccctgtctctcatctgcactgttctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgctctccctgaaactgacctccgtgaccgccgcggacacggccgtttatttctgtgcgaggcgagactggtctttcaatctatggggccgtggcaccctggtcactgtctcctcagcttccaccaagggccatcggtcttcccctggcgccctgctccaggagcacctctgggggcaacagcggccctgggctgcctggtcaaggactacttcctatatactgtctgagcgggctggcaaggcgcatag

SEQ ID NO: 790283 - DNA, 679 bp, Homo sapiens
  misc_feature: 9667.UNK.UNK.UNK.pb.heavy.1.raw 9667
ctatgcgccttgccagccccgctcagacagtatataggaagtagtccttgaccaggcagcccagggccgctgtgcccccagaggtgctcttggaggagggtgccaggggaagaccgatgggcccttggtggaggctgaggagacggtgaccagggttccctggccccaggggttcgaggccagttcgcccccccgtctctacttgtatcgataggaatctctcgcacaataatatacggccgtgtccgcggcggtcacagaagtcaatttcagggagaactggttcttggacctgtctagtgacatggtgactcgactcttgagggcggggttgtagtttggtgctgcactgttatagatgcgcccaatccactccagtcccttccggcggactgccgcagccactccaaataataactactgatggtaaccaccagagacacttgcaggtgagggacagggtctccgaaggcttcacccgtcctgggcccgactcctgcagcctgcacctcggacacgaccatctgggagtgccaccaggaggaggaagaaccacaggtgtttcatgttcttgtgcaggagcccatgagtctcagaaagtatccccaaacccaactatcgtggctacctcggcaccggtcgtgtatatactgtctgatggcgcgagggaggcgatacg

SEQ ID NO: 790284 - DNA, 673 bp, Homo sapiens
  misc_feature: 9685.44.71.G05.1.pb.heavy.1.raw 9685
cgtatcgcctccctcgcgccatcagacagtaatacacgaccggtgctcgatttagtgtcgtcgcaagagagaggagcccagccctgggactgaacagagagaactcaccatggagtttgggctgagctggctttttcttgtggctgttttaaaaggtgtccagtgtgaagtgcagctgttggagtcggggggaggcttggtacagccgggggggtccctgacactctcctgtgcagcctctggattcgcctttaatacctatgccatgatctgggtccgtcaggccccagggaaggggctggagtgggtctcatccattactggtggtagtgccacaaatgtcgcagactccgtgaagggccgcttcatcgtctccagggacaattccaagaatacggtgtttctgcagatgaagagcctgcgagtggacgacacggccctttattactgtgccagagggtcgcagaagttacaacaatacaagtattactactacatggacgtctggggcaaagggaccccggtcaccgtctcctcagcctccaccaaggcccatcggtcttccccctggcacccctcctccaagagcacctctgggggcacagcggccctgggctgcctggtcaaggactacttcctatatactgtctgagcgggctggcaaggcgcatag

SEQ ID NO: 790285 - DNA, 689 bp, Homo sapiens
  misc_feature: 9748.44.74.G08.1.pb.heavy.1.raw 9748
cgtatcgcctccctcgcgccatcagacagtatatacacgaccggtgctcgatttagtagctctatcagggggagcatcacataacaaccacatttcctcctctaaaagagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacgcctctggaagtactacagttccactacttataccatcaactgggtgcgccagggccctggacaagggcttgagtggatggtggaatcatccctctttttggctcactcacctacgcacgagacttccggggcagaattacgattacgcggacaagtccacagacacagtctccatgacaatgagttctttgaaatccgacgacacggccgtctactactgtgcgagaggtccgtaccccagctcgcatggagcctttgaggatctgggggcaggaacccctggtcattgtcacctcagcttccaccaagggcccatcggtctttcccctggcgccctgctccaggagcacctctggggcacagcggccctggctgcctggtcaaggactacttcctatatactgtctgagcgggctggcaaggcgcatag

SEQ ID NO: 790286 - DNA, 729 bp, Homo sapiens
  misc_feature: 9751.UNK.UNK.UNK.pb.heavy.1.raw 9751
tatgcgccttgccagccccgctcagacagtatataggaagtagtccttgaccaggcagcccaggccgctgctgcccagaggtgctcctggagcaggcgccagggggaagaccgatgggcccttgtggaagctgaagagacggtgaccattgtcccctggccccaaatatcaaatgcatcgacgtccccaggatcgcctggcggcgagtaatagacgcctgtgtcgtcgggtctcaggttgctcatttgtaaatggccaacactgttggagtcatcccttgagacggtgaatcttcccttcacagacgcgggcgtactctttacttccacccataaacgtttcattctgacgaaagtgatccactcaagccccttccctggagcctgacggacccaggccaagtgataatcactaagactgaatcctgagactacacaggagagtctcagagaccgccctggctgtgccaagccgcccccgactccgccagtcgcccctcgcactgacaccttctaaaaaaaactacaggaaaatcaagattagcccaaactccatggttggtggtctgtgctccagtgctgcatcaccaagtggaaactcctgggaatctcacggctgggggctcctctccccagagctccgcctttgctgtgtgttcagacgcgtctgctaaatcgagcacccggtcgtgggtatatactgtctgatggcgcgagggaaggcgatacg

SEQ ID NO: 790287 - DNA, 718 bp, Homo sapiens
  misc_feature: 9761.UNK.UNK.UNK.pb.heavy.1.raw 9761
ctatgcgccttgccagcccgctcagacagtatataggaagtagtccttgaccaggcagcccaggccgctgtgctctcggaggtgctcctggagcagggcgccagggggaagaccgatgggcccttggtggaggctgaagagacggtcaccactgtcccccggccccaaagtactaaaggtgtcatgggggtcaccgtggtcctggctttcaaacagtaatagacgcctgtgtcctcgggtctcaggtttttcatttggagaaacaatttgtcctgcgaattgtccctggaaatggtgaagcggccccttcacggagtctccgtagaaagtgacaccaccagctccgatacttgagacccactccagtcccctccctggagcccggcggacccaggtcatgccataggcactaaaggtgaatccagaggccgcacaggagagggtcaggacctcccaggccgaatcaggcccccccccagactccaaacaactgcacttcacacacgacaccctttaaaaaagcccacaagaaaaaggcagctcagccccaaactccatggagacttctctctgttcggtcctggtcaccaaatgaagacacctgaaaatccagggctgggctcctctctcagaggcctcccctttccctttatggcgactactaaatcgagcaccggtcgtgtatatactgtctgatggcgcgaagggaggcgatacg

SEQ ID NO: 790288 - DNA, 715 bp, Homo sapiens
  misc_feature: 9766.UNK.UNK.UNK.pb.heavy.1.raw 9766
cgtatcgcctccctcgcgccatcagacagtatatacacgacggtgctcgatttagtatcactcagtcgcgggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcagctggtggagtctgggggaggcgtggtccagcctgggaggtccctgagactctcctgtgcagcgtctggattcaccttcagctacctatggcatgcactggtccgccaggctccaggcaaggggctggagtgggtggcacttatatggtatgatggaagtaataaatactatgcagactccgtgaagggccgattcaccatctcagagacaattcaagaacacgctgtatctgcaaatgaacagcctgagagccgaggacacggctgtgtattactgtgcgaggacatattgtagtactaccacctgctgggactactactacggtatggacgtctggggccaaggaccacggtcaccgtctcctcagcctccacccaaggggccatcggtcttccccctggcaccctcctccaagagcactctctggggcacagcggcctggctgcctggtcaaggactacttcctatactgtctgagcgggctggcaaggcgcatag

SEQ ID NO: 790289 - DNA, 702 bp, Homo sapiens
  misc_feature: 9770.44.27.C05.1.pb.heavy.1.raw 9770
cgtatcgcctccctcgcgccatcagacagtatatacacgaccggtgctcgatttagacgcgatcgaagggtttgggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggcctgggctgcctggtcaaggactacttcctatatactgtctgagcgggctggcaaggcgcatag

SEQ ID NO: 790290 - DNA, 725 bp, Homo sapiens
  misc_feature: 9783.UNK.UNK.UNK.pb.heavy.1.raw 9783
cgtatcgcctcctcggccgcccatcagacagtatatacaccgaccggtggctcgattagtagtccgcaaataaagggaaaggggagctctgagagaggagcacccagccctgggattttcaggtgtcttcatttggtgaccaggacccgaacagagagaagtctccatggagtttggggcctgagctgccttttttcttgtggctttttttaagggtgtcgtgtgtgaagtgcagttttggagtctggggggggcctgattcggcctggggaggtccctgaccctctcctgtgcgccctctggattcacctttagtgcctatggcatgaacctgggtccgccgggctccagggaggggactggagtgggtctcaagtattcggagctggtggtgtcactttctacggagactccgtgaagggccgcttcaccatttccaggggacaattcgcaggacaaattgtttctccaaatgaaaaaacctgagacccgagaccacaggcgtctattactgtttgaaagccaggaccacggtgacccccatgacacctttagtacttggggcgggggacagtggtgaccggtctcttcagcctccaccaaggggcccatcggtcttcccctggcgccctgctcaggagcacctccgagagcacagcggcctgggctgcctggtcaaggactacttcctatatactgtctgagcgggctggcaaggcgcatag

SEQ ID NO: 790291 - DNA, 650 bp, Homo sapiens
  misc_feature: 9784.UNK.UNK.UNK.pb.heavy.1.raw 9784
ctatgcgccttgccagcccgctcagacagtatataggagtagtccttgaccaggcagcccagggccgctgtgctctcggaggtgctcctggagcagggcgccagggggaagaccgatgggcccttgtggaggctgatgagacggtgacctggattccctggccccagggttcgaagaagcccgtggtcattgtggtcatgaagtgggcacagaaatatgtgcctgtgtccacagggtccacgttggtcaatgtaagaccacctggtttttggacgtgtccttcgtgagcgtgagtctggtcgtcagagaaggactatatcgtatatcgtcattccaataagtgagtgcgatccactccagggcctttccggggggctgccgcacccagacaacgccctctccaggagtgacgagtgagaagcctgagacggtgcaggtcagcgtgaagggtctgtgtgggttttcaccatgtagggccagactctttcacggtgatctgggacaggccccatgaagggatggtcagcagcaggagcgtggagcaaagtgtgtccatggtgggcacaggagtccccctttcccttcaccactacactaatcgagcaccggtcgtgtatatactgtcttgatggcgcgagggaggcgatacg

SEQ ID NO: 790292 - DNA, 678 bp, Homo sapiens
  misc_feature: 9800.44.72.G06.1.pb.heavy.1.raw 9800
cgtatcgcctccctcgcgccatcagacagtatatacacgaccggtgctcgattagctacgactgcaagggaaaggggagagaggagcttagccctggactccaaggcctttccacttggtgatcagcactgagcacagaggactcaccatggaattggactgagctgggttttccttgttgctattttagaaggtgtccagtgtgaggtgcaactggtggagtctgggggaggcttgtccagcctgggggtcctgaactctctgtgcagcctctggattcacctttagtagttattggatgaactgggtccgccaggctccagggaagggctgagtgggtggccatcatgaagaaagatggaactgagacacactatgtggactctgtgaagggccgattcaccatctccagagacaacgccaagaactcactgtatctgcaaatgaacagtctgagagtcgaggacacggctgtgtttattgtgcgggaggcgctgggtggctcattgactactgggtcagggaaccctggtcaccgtctcctcagcctccaccaagggcccatcggtcttcccctggcgccctgctccaggagcacctccgagagcacagcggcctggctgcctggtcaaggactacttcctatatactgtctgagcgggctggcaaggcgcatag

SEQ ID NO: 790293 - DNA, 706 bp, Homo sapiens
  misc_feature: 9813.UNK.UNK.UNK.pb.heavy.1.raw 9813
ctatgcgccttgccagcccgctcagacagtatataggaagtagtccttgaccaggcagcccagggccgctgtgcccccagaggtgctcttggaggagggtgccaggggaagaccgatgggcccttggtggaggcggaggcgacggtgaccagggttccctggccccagaagtcaaacgaataataaccactccgagcgccgacttgttctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagaccccactccagccccttccctggagcctggcggacccaactcatgtagttgctgctgacggtgagcccagaggctgcacaggagagtctctgggacccccaggctggactaaagcctcctccagactccatcagccgcacctcacactggacacctttttaaaagtccaacaaggagaacccagctcagccaaaactccatggtgagtcctctgtgttcagtgctgatcacggaatggaaacacctcggaatcccagtgctgggctcctctccccaaacccaacgtgcggagtgctaaatcgagcaccggtcgtgtatatactgtctgatggcgcgagggaggcgatacg

SEQ ID NO: 790294 - DNA, 692 bp, Homo sapiens
  misc_feature: 9936.UNK.UNK.UNK.pb.heavy.1.raw 9936
cgtatcgcctccctcgcgccatcagacagtatatacaacgacggtgctcgatttagctgcgtcacgatctctctttgggggagagcgagccccagccccagaattcccaggtgttttcattgtgatcagcaactctgaacacagaggactcaccatggagttcggctgagctgggttttcttgttgttattttacaggggtccagagggaagtgcagttggtggagtccgggggagacttggtccagcctggagggttcctgagactctcctgtgtcgcctctggattcaccatcagtgaccactatatgggactggtccgccaggctcagggaagggctggagtggcttggccggcagtaaaaacaaagttgccagctttatcacagagtacgccgcgtctggaaagcccagattcaccctctcaaggagatgaacttcaagaactcattgattcgcgatgactacctgaaaccgaggacacgggcatgtatctattgtgttgtgtttatatcaggaactgtccactggggccagggaaaccctggtcaccgtctcctcagcctccaccaagggcccatcggtcttcccctgccgcctgctccagggcacctccgagagcacagcggccctgggctgcctggtcaaggactacttcctatatactgtctgagcgggctggcaggcgcatag

SEQ ID NO: 790295 - DNA, 617 bp, Homo sapiens
  misc_feature: 9963.44.23.C01.1.pb.heavy.1.raw 9963
ctatgcgccttgccagcccgctcagacagtatataggaagtagtccttgaccaggcagcccaggccgctgtgccccagagggtgctcctggagcaggggcgccagggggaagaccgatgggcccttggtgaagctgagggacagtgaccaggtgccacggccccatagattgaaagaccagtccgcctcgcacagaaataaacgccgtgtccgcggcggtcacggaggtcagtttcagggagaagcggttcatggacgtgtccctcgaaatggtgagacgactcttgagggacggagaagtagtacgtcgcccagtataatggatgtcaccaatccactccattccccctccctgggggctgccggatccagccccaagaatgatcagaaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgttcaccctgccccaatccctaatcacgtgtactaaatcgagcaccggtcgtgtatatactgtctgatggcgcgaggaggcgatacg

SEQ ID NO: 790296 - DNA, 725 bp, Homo sapiens
  misc_feature: 9991.44.85.H08.1.pb.heavy.1.raw 9991
ctatgcgccttgccagcccgctcagacagtatataggaagtagtccttgaccaggcagcccagggccgctgtgcccccagaggtgctcttggaggagggtgccaggggggaagaccgatgggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctcccccagactccaccagctgcacctgacactggacacctcttaaaagagcaacgaggaaaaccccagctcagcccaaactccatggtgagtcctctgtgttcagtgctgatcaccgaatggaaacaccgccgacttctagtgctgggctcctctcccagagctccccgcgactgagtgatactaaatcgagcaccggtcgtgtatatactgtctgatggcgcgagggaggcgatacg

SEQ ID NO: 790297 - DNA, 602 bp, Homo sapiens
  misc_feature: 10005.UNK.UNK.UNK.pb.heavy.1.raw 10005
gggctgggcaggctatgcaccctggtccaggtcaaaagctgcggacccgctagcggccatcttggccactaggggtcccgcagattgcatattgtcgctagcatgcacaatgctgcaaacccagcttgcaatgcccacagcaagcggccaatcttacggcccacgttgaatgtttattacctgtgactggctatggcttgcaacgccactcgtaaactagtactttgcggttaggggaagtagacaaacccattactccacttcccgaagttcaactcattccaacacgaaataaagtaaactcaacaccccaagcaggcattgtggggcggggtgataggggtggattctatttcctatcccatcccctaggatctcaattagttactagcgagttaaatgtctgtagcgatcccgtcagtccgtatcgcgcgcatcaagacctggtggttgagcggtgcagtagatcatcgataagctggcgagttaggtcatccagaccgcatctggcgcctaacgttcagtggtagctaaggcgtcaccttcgacgtgtctaaaggcaatatgtcgtcttagctccaagtccctagcagcgtgtcggg

SEQ ID NO: 790298 - DNA, 640 bp, Homo sapiens
  misc_feature: 10006.44.19.B08.1.pb.heavy.1.raw 10006
ctatgcgccttgccagcccgctcagacagtatataggaagtagtccttgaccaggcagccagggccgctgtgctctcggaggtgctcctggagcagggcgccaggggaagaccgatgggcccttggtggaggctgatgagacggtgacctggattccctggccccagggttcgaagaagcccgtggtcattgtggtcatgaagtgggcacagaaatatgtgcctgtgtccacagggtccacgttggtcaatgtaaggaccacctggtttttggacgtgtccttcgtgagcgtgagtctggtcgtcagagaaggactatatcgtatatcgtcattccaataagtgagtgcgatccactccagggcctttccgggggctgccgcacccagacaacgccctctccaggagtgacgagtgagaagcctgagacggtgcaggtcagcgtgagggtctgtgtggtttcaccaatgtagggccagactctttcacggtgatctgggacaggcccatgaagggatggtcagcagcaggagcgtgagcaaagtgtgtccatggtggggcacaggagtcccccttactgactcactaaatcgagcaccggtcgtgtatatactgtctgatggcgcgagggaggcgatacg

SEQ ID NO: 790299 - DNA, 704 bp, Homo sapiens
  misc_feature: 10021.44.36.D03.1.pb.heavy.1.raw 10021
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790300 - DNA, 604 bp, Homo sapiens
  misc_feature: 10023.UNK.UNK.UNK.pb.heavy.1.raw 10023
gaaggctgggcaggctatgcaccctggtccaggtcaaaagctgcggaaccgctagcgccatcttggccactaggggtcccgcagattcatattgtcgtctagcatgcacaatgctgcaaaccagcttgcaatgcccacagcaagcggccaatctttacgccacgttgaattgtttattacctgtgactggctatggcttgcaacgccactcgtaaaactagtactttgcggttaggggaagtagacaaaccattactccacttcccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 790301 - DNA, 652 bp, Homo sapiens
  misc_feature: 10026.44.53.E09.1.pb.heavy.1.raw 10026
ctatgcgccttgccagcccgctcagacagtatataggaagtagtccttgaccaggcagcccagggccgctgtgctctcggaggtgctcctggagcagggcgcagggggaagaccgatgggcccttggtggaggctgaggatgaggagacggtgaccgtggtcccttggccccagacgtcccagcgtagtagaattgagacgacctgccataggcggacccatgtctgacacagtagtagacagccgtgtcggcggcggccacagaactcactttcaggaaaaactgtgtcctcgacgtgtccacggatatggtgactcgaccgttgagggacgggttgtagtaggtgttcccactataatagagactcccaatccactgcagcccctctcctggggctggcggatccagcccagtagaaatttacttctgtcgatggaggcaccagagaccgtgcacgtgagggacagggtctccgaaggcttcaccagtcctgggcccgactcccgcagctgcggctgagacaggaacccatctgggagccgccaccagcaggaggaagaaccacaggtgcttcccccaaacccaacacactctctctaaatcgagcaccggtcgtgtatatactgtctgatggcgcgaggaggcgatacg

SEQ ID NO: 790302 - DNA, 701 bp, Homo sapiens
  misc_feature: 10027.UNK.UNK.UNK.pb.heavy.1.raw 10027
cgtatcgcctcctcgcgccgatcagacagtatatacacgaccggtgcgctcgattgtactctacgctcagggggggagacgagcccagcacgggaagtcgccgggtttccattccggtgatcgatcactgaagcacagaggactcaccatggactttgggctgagatgggtttcctcgttgctcttttaagaggtgggcagtgtcaggtgcagctagtgaggtctggggaggagcggccccagcctgggaactccctgagactctcctgtgcagcctctggattcatcttcaggactatgccatgcactggtccgccaggctccaggcaaggctggagtgggtggccaattatatcagaagatggaattgaagacactacggagactgccgagaagggccgattcaccgtctccagagacaattccaggaacacactgcatctgcaaatgtacaacctcacagtgaggacacggctgtctattcattcgtggcgagagccccctcgagacgcgtccccgcttgactactggggccagggaaccctggtcaccgtctcctcagcctcaccaagggccgcatcggtcttcccctggcgccctgctccggagcacctccgagagcacagcggcccggctgggctgcctggtcaaggactacttcccgtatattacctgtctgagcgggctggcaaggcgcatag

SEQ ID NO: 790303 - DNA, 533 bp, Homo sapiens
  misc_feature: 10065.44.43.D10.1.pb.heavy.1.raw 10065
cgtatcgctccctcgcgccatcagacagtatatacacgaccggtgctcgatttagactagcagtaagggctgaggtgaagaagcctgggcctcagtgaaggtctcctgcaaggcttctggatacaccttcaccaattatgatatcaactgggtgcgacagccactggacaaggcttgagtggatgggatggcatggaccctaacagtggtaaacagctatgcacagaagttccagggcagagtcaccatgaccaggaaaacacctccataaaacagcctacatggaggctagcagctgagatctgaggaccacggcgtgtattactgtgcgagatcccgaaagtatagcagctcgtcggaggtggttcgaccctggggccaggaacctggtcaccgtctcctcagcttccaccaagggccatcggtcttccctgcgcctgctccaggagcacctctgggggcacagcggccctggctgcctggtcaaggactacgtcctatatactgtctgagcgggctggcaaggcgcatag

SEQ ID NO: 790304 - DNA, 525 bp, Homo sapiens
  misc_feature: 10111.44.38.D05.1.pb.heavy.1.raw 10111
cgtatcgcctcctcgcgccatcagacagtatatacacgaccggtgctcgattagtatctgatagttcagcctgggggtcctgagactctcctgtgcagctctggattcaccttcagtagctactggatgcactgggtccgccagctccagggaaggggctggtgtggtctcacgtattaatagtgatggagtagcacaagctacgcggactccgtgaaggccgattcaccatctccagagacaacgccaagaacacgctgtatctgcaaatgaacagtctgagagccgaggacacggctgtgtattactgtgcaagagccggtgcgggagttcgggagttgcatactactactacggtatggacgtctgggcaaggaccacggtcaccgtctcctcagcttccacaagggcccatcggtcttccctggcgcctgctccaggagcacctctggggcacagcggccctggctgcctggtcaaggactacttcctatatactgtctgagcggctggcaaggcgcatag

SEQ ID NO: 790305 - DNA, 722 bp, Homo sapiens
  misc_feature: 10149.UNK.UNK.UNK.pb.heavy.1.raw 10149
ccttgccagcccgctcagacagtatataggaagtagtccttgaccaggcagcccagggccgctgtgcccccagaggtgctctggaggagggtgccagggggaagaccgatgggcccttggtggaggcttgaggacggcgaccgtggtcccttggccccaggcgtccattaccattggagtagagcatgtcatatctgtatccacgagccccatctctcgcacagtagtagacagccgtgtctcggctctcaggctattcatttccagatatagtgtgttttcttcgaattgtctctggagatggtgaatcggcccttcacggaatctacataatatttattacttcatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaaccccaggtcagcccaaactccatggtgagtcctctgtgttcggtgctgatcacgactggaaaacaccgccgacttctggtgctgggctcctctcccagagctccccaaacccaacgagctcactctaaatcgagcaccgtcgtgttatactgtctgatggcgccgagggaggcgatacg

SEQ ID NO: 790306 - DNA, 695 bp, Homo sapiens
  misc_feature: 10156.UNK.UNK.UNK.pb.heavy.1.raw 10156
ctatgcgccttgccagcccgctcagacagtatataggaagtagtccttgaccaggcaggcccagggccgctgtgcccccagaggtgctcctggagcagggcgccagggggaagaccgatgggcccttggtgaagctgaagagacggtgaccattgtcccctgggccccaaatatcaaatgcatcgacgtcccaggatcgcctggcgcagtaatagacgcctgtgtcgtcgggtctcaggttgctcatttgtaaatggccaacacctgttggagtcatcccttgagacggtgaatcttcccttcacagacgcggcgtactctttacttcccctcgaacgtttcattctgacgaaagtgatccactcaagccccttccctggagcctgacggaccaggcaagtgataatcactaagactgatcctgagactacacaggagagtctcagagagaccgccctgggctgtgcaagccccccgactcgcagtcgccccctcgcactggacaccttctaaaaaactacaaggaaatcaagattagcccaaactccatggttggtggtctgtgctcagtggctgatcaccaagtggaaaactcctgggaatccacggctgggcggctcctctctcttgcgacgacactaaatcgaggcaccgtcgtgtatatactgtctgatggccgcgagggaggcgatacg

SEQ ID NO: 790307 - DNA, 665 bp, Homo sapiens
  misc_feature: 10209.UNK.UNK.UNK.pb.heavy.1.raw 10209
ctatgcgccttgccagcccgcttcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcgggtcacggaggtcagtttttcagggagaagcggttcatggacgtgtccctcgaaaatggtgagacgactcttgagggacggagagtagtacgtcgcccagtataatggatgtcaccaatcccactccattcccctccctgggggctgccggatccagccccaagaatgatcagaactgatggaaaactccagagacagtgcagatgagagacagggttcccgaaaggcctcaccagtcctgggcccgactcctgcagctgcacctgggacaggacccatctgggagctgccaccagcagggaggaaaaaaccacaggtgcttcatgtttcttgcacaggaggtccttgactctcagaaagccccaatccctaattcacgtgtactaaaatcgagcaccggtcgtgtatatactgtctgatggcgcgagggaggcgattacg

SEQ ID NO: 790308 - DNA, 715 bp, Homo sapiens
  misc_feature: 10250.UNK.UNK.UNK.pb.heavy.1.raw 10250
tggtatcgcctccctcgcgccatcagaccagtatataccacgaccggtgctcgattttagtgagtcaagtaagggaaagggggctgggagaggagcccagcactagaagtcggcggtgtttcccattcggtgatcagcactgaacacagaggactcaccatggagtttgggctgagctgggtttttcctcgttgctctttttaagaggtgtccagtggtcaggttcagctggtgggagtctggggaggccgtggtccagcctgggacgtcctgagaacttctcctgtgttgcgtccggactcagttttcagtgactctgccatgccaactggtcccgccaggctccaggcaaggggctgggtgggtggcagtcatctggtcctgatggaagtaaagaatactatggaaaactcccgtgaagggccgatttctccgtctccagagaacaattccaagaaaccaccggtgtatctacaaaatgaacaatttgagagccgaggactcggcctctctattattgtacgagcccatcgttcttactgggccagggaagggccctggtcaccgtctcctcagcctccaccaagggcccatcggtcttccccccctggcgcctgctccaggagcaccttccgagagcacagcgggcccctgggctgctggttcaaggaactacttcctatatactgtctgagcgggctgcaaaggcgcatag

SEQ ID NO: 790309 - DNA, 707 bp, Homo sapiens
  misc_feature: 10275.44.56.F01.1.pb.heavy.1.raw 10275
ctatgcgccttgccagcccgctcagacagtatataggaagtagtccttgaccaggcagcccagggccgctgtgccccagaggtgctcctggagcagggcgccagggggaagaccgatgggcccttggtggaagctgaagagacggtgaccattgtcccctggccccaatatcaaatgcatcgacgtcccaggatcgcctggcgcagtaatagacgcctgtgtcgtcgggtctcaggttgctcatttgtaaatggccaacactgttggagtcatcccttgagacggtgaatctcccttcacagacgcggcgtactctttactccaccataacgtttcattctgacgaaagtgatccactcaagccccttccctggagcctgacggacccaggccaagtgatatcactaagactgaatcctgagactacacaggagagtctcagagaccgccctggctgtgccaagcccccccccgactccgccagtcgcccctcgcactggacaccttctaaaaaaaactacaaggaaatcaagatagcccaaactccatggttggtggtctgtgctcagtgctgatcaccaagtggaaactcctgggaatctcacggctggggctcctctcccagagctccctttgtgtgtcagacgtctgctaaatcgagcaccggtcgtgtatatactgtctgatggcgcgagggaggcgatacg

SEQ ID NO: 790310 - DNA, 714 bp, Homo sapiens
  misc_feature: 10300.44.33.C11.1.pb.heavy.1.raw 10300
cgtatcgcctccctcgcgccatcagacagtatatacacgaccggtgctcgatttagagtgagctcgttgggtttggggagctctggagaggagccagcaccagaagtcggcggtgtttccagtcggtgatcagcaccgaacacagaggactcaccatggagtttgggctgacctgggttttcctcgtttgctctttaagaggtgtccagtgtcaggtgaagctggtggagtctgggggaggcggggtccagcctgggagtccctgagactctcctgtgtagcgtctggattcaccttcaacagacatggcatgcactggtccgccaggctccaggcaagggactggagtgggtggcacttatatggtatgatggaagtaataaatattatgtagattccgtgaagggccgattcaccatctccagagacaattcgaagaacacactatatctggaatgaatagcctgagagccgaggacacggcggtctactactgtgcggagaatggggctcgtggatacagatatgacatgctctactccaatgtatggacgcctggggcaaggaccacggtcgcgtctcctcagcctccaccaagggcccatcggtcttcccctggcaccctctccaagagcacctctggggcacagcggccctgggctgcctggtcaaggactacttcctatactgcgagcgggctggcaaggcgcatag

SEQ ID NO: 790311 - DNA, 600 bp, Homo sapiens
  misc_feature: 10338.UNK.UNK.UNK.pb.heavy.1.raw 10338
gaaggctgggcaggctatgcacccctggtccaggtcaaaagctgcggaaccgctagcggccatcttggccactaggggtcccgcagattcatattgtcgtctagcatgcacaatgctgcaaacccagcttgcaatgccacagcaagcggccatcttttacgccacgttgaattgtttattacctgtgactggctatggcttgcaacgccactcgtaaaactagtactttgcgttaggggaagtagacaaaccattactccacttccgaagttcaactcattccaacacgaaataaaagtaaactcaacacccaagcaggctatgtgggggtgatagggtggattctatttcctatcccatcccctaggatctcaattaagttactagcgagttaaatgtctgtagcgatcccgtcagtcctatcgcgcgcatccaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 790312 - DNA, 718 bp, Homo sapiens
  misc_feature: 10347.44.85.H08.1.pb.heavy.1.raw 10347
cgtatcgcctccctcgcgccatcagacagtatatacacgaccggtgctcgatttagtatcactcagtcgcgggagctctggagaggagcccagcactagaagtcggcggtgtttccattcggtgatcagcactgaacacagaggactcaccatggagtttgggctgagctgggtttcctcgtgctcttttaagaggtgtccagtggtcaggtgcagctggtggagtctggggaggccgtggtccagcctgggaggtccctgagactctcctgtgcagcgtctggattcaccttcagtacctatggcatgcactgggtccgccaggctccaggcaagggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaagggcccatcggtcttcccctggcaccctcctccaagagcacctctgggggcacagcggccctgggctgcctggtcaaggactacttcctatatactgtctgagcgggctggcaaggcgcatag

SEQ ID NO: 790313 - DNA, 697 bp, Homo sapiens
  misc_feature: 10406.UNK.UNK.UNK.pb.heavy.1.raw 10406
cgtatcgcctccctcgcgccatcagtctatactatcacgaccgggtgctcgatttagctgcgtcacgatctctcttggggagctctgagagcggagccccagccccagaattcccaggtgttttcatttggtgatcagcactgaacacagaggactcaccatggagttcggctgagctgggttttccttgttgttattttacaaggtgtccagagtgaagtgcagttgtggagtccggggagacttggtccagcctggagggtccctgagactctcctgtgtcgcctctggattcaccatcagtgaccactatatggactgggtccgccaggctccagggaaggggctggagtggctggccgcagtaaaaacaaagttgccagctttatcacagagtacgcccgcgtctgtgaaagccagattcaccctctcagagatgacttcaagaactcattgattctgcgaatgactaacctgaaaaccgaggacacgggcatgtattattgtgttgtgtttatatcaggaactgtccactgggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgc

SEQ ID NO: 790314 - DNA, 712 bp, Homo sapiens
  misc_feature: 10423.UNK.UNK.UNK.pb.heavy.1.raw 10423
cgtatcgcctcctcgcgcatcagacagtatatacacgaccggtgctcgattagcagaccgtctgaacacacaaaggggagctctggagaggagccccagccgtgagattcccaggagtttccacttggtgatcagcactgagcacagaccaccaaccatggagttttgggctaatcttgattttccttgtagtttttttagaaggtgtccagtgcgaggggcgactggccggagtcgggggggccttggcacagccagggcggtctctgagactctcctgtgtagtctcaggattcagtcttagtgattatcacttggcctgggtccgtcagtctccagggaagggggcttgagtggatcacttttcgtcagaatgaaacgttatggtggaagtaaagagtacgccgcgtctgtgaaggaagattcaccgtctcaaggatgactgccaacagtgttggccatttacaaaatgagcaactgagaccccgacgacacaggcgtctattactgcgccaggcgatcctggacgtcgatgcatttgatatttggggccagggacatggtcaccgtctcttcagcttccaccaagggcccatcggtcttcccccctggcgccctgctccaggagcacctctgggggcagcggccctgggctgcctggtcaaggactacttccctatatactgtctgagcgggctggcaagcgcattag

SEQ ID NO: 790315 - DNA, 705 bp, Homo sapiens
  misc_feature: 10471.44.27.C05.1.pb.heavy.1.raw 10471
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgctggagcctggcggacccactgcatattccaattatcgaaggtgaatccagaggctgccacaggagagtctcagggaccccctactggggccacgcctccccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccaggccccaaacccttcgatcgcgtctaaatcgagcaccggtcgtgtatatactgtctgatggcgcgagggaggcgatacg

SEQ ID NO: 790316 - DNA, 665 bp, Homo sapiens
  misc_feature: 10491.44.12.B01.1.pb.heavy.1.raw 10491
cgtatcgcctccctcgcgccatcagtctatactatcacgaccggtgctcgatttagtagtgtagattccgcgggggctttctgagagtcatggacctcctgtgcaagaacatgaagcacgctgtggtttcttctcctgctggtggcggctccagatgggtcctgtcccagctgcagcttgcaggagtcggccaggactggtgaagccttcggagaccctgtccctcacctgcactgtctctggtggctccatcagcagtagtagttactactgggctggatccgccagcccccagggaaggggcctggagtggattgggagtatctattatagtgggaagcacctactacaacccgtccctcaagagtcgagtcaccatatcagtagaccacgtccaagaaccagttctccctgaagctgagctctgtgaccgccgcggacacggccgtgtattactgtgcgagagtagggcagttcgtcaccaactactctttgaccactggggccagggaaccctggtcaccgtctcctcagcctccaccaagggccatcgtcttcccctggcaccctcctccaagagcacctctgggggcacagcggccctgggctgcctggtcaaggactacttcctatatactgtctgagcgggctggcaaggcgcatag

SEQ ID NO: 790317 - DNA, 685 bp, Homo sapiens
  misc_feature: 10511.44.36.D03.1.pb.heavy.1.raw 10511
ctatgcgccttgccagcccgctccagacagtatataggaagtagtccttgaccaggcagccagggccgctgtgctctcggaggtgctcctggagcagggcgccagggggaagaccgatgggcttggtggaggctgaggagacggtgaccagggttcctggccccagtggacagttcctgatataaacacaacacaataatacatgccgtgtcctcggtttcaggttagtcattcgcagaatcaatgagttcttgaagtcatctcttgagaggtgaatctggctttcacagacgcggcgtactctgtgataaagctggcaactttggttttttacgcgggcaagccactccagcccttcctggagcctggcggaccagtccatatagtggtcactggatggtgaatcagaggcgacacaggagagtctcagggaccctcccggctggacaagtctcccccggactccaccaactgcacttcactctggacaccttgtaaaataacaacaaggaaaacccagctcagccgaactccatggtgagtcctctgtttcagtgctgatcaccaatgaaacacctgggaattctggggctggggctccgctctcccccaagagagatcgtgacgcagctaaatcgagcaccggtcgtgtatatactgtctgatggcgcgaggaggcgatacg

SEQ ID NO: 790318 - DNA, 716 bp, Homo sapiens
  misc_feature: 10512.44.85.H08.1.pb.heavy.1.raw 10512
ctatggccttgcccagcccgctcagacagtatataggaagtagtccttgaccaggcagcccagggccgctgtgccccagaggtgctcttggaggagggtgccagggggaagacgatgggcccttggtggaggctgaggagacggtgaccgtggtcccttggccccagacgtccataccgtagtagtagtcccagcaggtggtagtactacaatatgtctcgcacagtaatacacagccgtgtcctcggctctcagctttccatttgcagatacagcgtgttcttggaattgtctctggagatggtgaatctggcccttcacgagtcttgcatagtatttattacttccatcataccatataagtgccaccactccagccccttgcctggagcctggcggacccagtgcatgccataggtactgaagtgaatccagacgctgcacaggagagtctcagggacctcccaggctggaccacgcctccccagactccaccagctgcacctgacactgggacacctcttaaaagagcaacgaggaaaacccagctcagcccaaactccatggtgagtcctctgtgttcagtgctgatcaccgaatggaaacaccgcgacttctagtgctgggctcctctcccagagctccccgcgactgagtgatactaaatcgagcaccggtcgtgtatatactgtctgatggcgcgaggaggcgatacg

SEQ ID NO: 790319 - DNA, 691 bp, Homo sapiens
  misc_feature: 10564.UNK.UNK.UNK.pb.heavy.1.raw 10564
cgtatcgcctccctcgcgccatcagaccagtatatacacgaccggtgctcgatttagattctactgacaaccacattcctccttaaagaagcccctgggagcacagctcatcaccatggactggacctggaggttcctctttgtggtggcagcagcaacaggtgtccagtccctggtgcaactggtgcagtctggggactagaatgccgcaaccttgtcctcggtgaccctttcctgcacggcctctggaagtactaccagttccactacttataaccatcaactgggtggcgcccaggcccctggacaagggcttgagtggatgggtggaatcatccctctttttggctcactcacctacgcacgagacttccgggggcagaattacgattaccggcggacaagtccacagacacagttctccatgacaatgagtttctttgaaatccgacggacacggccgtctactactgtgcgagaggtccgtacccagctcgcatggagcctttgagatctggggggcagggaaccctggtcattgtcacctcagcttccaccaaggggcccatcggtcttcccccctggcgccctgctccaggagcacctctgggggcaccagcggccctgggctgcctggtcaaggactacttcctatatactgtcctgagcgggcctggcaagggcgcattag

SEQ ID NO: 790320 - DNA, 573 bp, Homo sapiens
  misc_feature: 10575.44.78.H01.1.pb.heavy.1.raw 10575
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggcttctttcacctcagcagcgtggtgaccgtgacctccagcaacttcggcacccaaacccaaactactcacactaaatcgagcaccggtcgtgtatatactgtctgatggcgcgagggaggcgatac

SEQ ID NO: 790321 - DNA, 683 bp, Homo sapiens
  misc_feature: 10591.44.73.G07.1.pb.heavy.1.raw 10591
ctatcgccttgccagcccgctcagacagtatataggaagtagtccttgaccaggccagcccagggccgctgtgctctcgaggtgctcctggagcagggcgccagggggaagaccgatgggcccttggtggaggctgaggagacggtgaccagtgtcccctggcccagtgaaacgccccgataatagctgctgccacttcccgatctcgcacagtaatacagagccgagtctcggcctctcaggctgatcatttccaggtacagagtgttccgggaattgtctctggagatggtgaatcggcccttcacggagtctgcataatatctagaagttccatcatatgctataactgccaaccactccggccccttgcctggagcctggcggacccagtgcatgccagaactactgaaactaaatccagaggcttcacaggagagtctcagggacctcccaggctggaccacgcctcccccagactccaccaggtgcacctgacactggacacctcttaaaagagtaacgaggaaaacccagctcagcccaaactccatggtgagtcctctgtgttcagtgctgatcaccgaatggaaacaccgccgagagcacagcggcctgagcgtagagctaaatcgagcaccggtcgtgtattatctgtctgatggcgcgagggaggcgatacg

SEQ ID NO: 790322 - DNA, 581 bp, Homo sapiens
  misc_feature: 10592.44.78.H01.1.pb.heavy.1.raw 10592
ctatgcgccttgccagcccgctcagacagtatataggaagtagtccttgaccaggcagcccaggccgctgtgctctcgaggtgctcctggagcagggcgccaggggaagaccgatggcccttggtggaggctgaggagacggtgaccagggttccctggcccacaagtcaagccaggtgctggtggctctcgcacagaaatacacggccgtgtcctcagatctcaggctgctcagttccatgtagactgtacctggggaggtgctcctggtcatactaactctgccttggaacttctggcaagcccgtgttgccactataggcttcatccatcccatccactccagcccttgtccagcggctgtcgcacccagttaatatcataattgatgaacgtgtatccagaagccgtgcaggagactgtcactgaggcccaggcttcttcacctcagcccagactgcaccagctgtacctgggagtgggaccgtcagtcttcctcttccccccaaacccaaactactcacactaaatcgagcaccggtcgtgtatatactgtctgatggcgcgagggaggcgatacg

SEQ ID NO: 790323 - DNA, 656 bp, Homo sapiens
  misc_feature: 10664.44.86.H09.1.pb.heavy.1.raw 10664
ctatgcgccttgccagcccgctcagacagtatataggaaagtagtccttgaccaggcagcccagggccgctgtgcccccagaggtgctcctggagcagggcgccaggggaagaccgatgggcccttggtggaagctgaggagacagtgaccaggggtgccacggcccccatagattgaaagaccagtctcgcctcgcacagaaataaacggccgtgtccgcggcggtcacggaggtcagtttcagggagaagcggttcatgacgtgtccctcgaaatggtgagacgactcttgagggacggagagtagtacgtcgcccccagtataatggatgtcaccaatccactccattcccctccctgggggctgccggatccagcccccaagaatgatcagaactgatgaaactccagagacagtgcagatgagagacagggttccgaaggcctcaccagtcctgggcccgactcctgcagctgcacctgggacaggacccatctgggagctgccaccagcaggaggaaaaaccacagggtgcttcatgttcttgcacaggaggtccttgactctcagaagcatccccaaacccaaagtctatagcactaaatcgagcaccggtcgtgtatatactgtctgatggcgcgaggaggcgatacg

SEQ ID NO: 790324 - DNA, 678 bp, Homo sapiens
  misc_feature: 10697.UNK.UNK.UNK.pb.heavy.1.raw 10697
ctatgcgccttgccagcccgctcagacagtatataggaagtagtccttgaccaggcagcccaggccgctgtgctctcggaggtgctcctggagcagggcgccagggggaagacgatgggcccttggtggaggctgaggagacggtgaccagggctccctggcccagtagaacgatgggctcgtacaataatagagagccgagtcctcggctctcaaattgttcatttgtagatacaccggtgttcttggaattgtctctggagacggagaatcggcccttcacggagtttccatagtattctttacttccatcagaccagatgactgccaccactccagccccttgcctggagcctggcggacccagtgcatggcagagtcactgaaactgagtccggacgcaaacacaggagagtctcagggacgtccaggctggaccacgcctccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctggctcctctcccagcccctttcccttactgactcactaaatcgagcaccgtcgtgtatatactggtctgatggcgcgagggaggcgatacg

SEQ ID NO: 790325 - DNA, 706 bp, Homo sapiens
  misc_feature: 10708.UNK.UNK.UNK.pb.heavy.1.raw 10708
ctatgcgcccgccagcccgctcagacagtatataggaagtagtccttgaccaggcagccccagggccgctgtgcccccagaggtgctcttggaggaggtgccaggggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagcccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaaccccagctcagccaaaactccatggtgagtcctctgtgttcagtgctgatcaccgaatggaaacaacctcggaatcccagtgctgggctcctctccccccaaacccaacgtgcgagtgctaaatcgagcaccggcgtgtatatacgtctgatggcgcgagggaggcgatacg

SEQ ID NO: 790326 - DNA, 553 bp, Homo sapiens
  misc_feature: 10710.UNK.UNK.UNK.pb.heavy.1.raw 10710
cgtatcgcctccctcgcgccatcagacagtaatacaccgaccggtgctcgatttagactagcagtaagggcctgaggtgaagaagcctggggcctcagtgaaggtctcctgcaaggcttctggatacaccttcaccaattatgtatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtggcgagatcccgaaagtatagcagctcgtcggggaggtggttcgacccctggggccagggaaccctggtcaccgtctcctcagcttccaccaagggcccatcggtcttccccctggcgccctgctccaggagcacctctgggggcacagcggccctggctgccctggtcaaggactactcgttcctatatactgtctgagcgggctggcaaggcgcatag

SEQ ID NO: 790327 - DNA, 722 bp, Homo sapiens
  misc_feature: 10712.UNK.UNK.UNK.pb.heavy.1.raw 10712
cgtatcgcctccctcgcgccatcagacagtatatacacgaccggtggctcgatttagacgcgatcgaagggtttggggctgggagacgagcccagcactggaagtcgccggtgtttccactcggtgatcatcactgaacacagaggactcaccatggagtttgggctgagctgggtttttcctcgtttgccctcttaagaggtgtcatgtgtcaggtgcaattcgtggagtctggggaggctgtggccccagtaggggggtcctgagactctccttgtgcagcctctggattccaccttcgataattggaaatgcagtgggttcccccaggatcaggctgagggggctggagtggggtggcaggtgtgtcatttcatggaggaaatcaagtttctacggtgattccgtttgagggccgattcaccatctccagaagacaattccgagaacaacagtgtctcttcaaatgaacagcctgagaccctcaggacacggccggtgttatttttgtgcgagactatctgttttccaaaatcggttcattcgacgcctggggccagggaaccctggtcaccgtctcctcggcctccaccaagggcccatcggtcttccccctggcgccctgctccaggagcacctccgagagcacagcggccctgggctgtgcctggtcaaggactacttcctatatactgtctgagcgggctggcaaaggcgcatag

SEQ ID NO: 790328 - DNA, 749 bp, Homo sapiens
  misc_feature: 10738.44.85.H08.1.pb.heavy.1.raw 10738
cgtatcgcctccctcgcgccatcagacagtatatacacgaccggtgctcgatttagtatcactcagtcgcggggagctctgggagagggagcccacgcactagaaaggtcggcggtgttttccattcggtgatcagcactgaacacagagcgactcaccatggagtttgggctgagctgggttttccctcgttgctcttttaaagaggtgtcccagtgtcaggtgcagctggtggagtctggggcggaggcgtggtccagcctgggaggctccctgagacctctcctgtgcacggcgtctggattcaccttcagtacctatggcatgcactgggtccgccaggctccaggccaagggggctggagtgggtggcacttatatggtatgatggaaagtaataaatactatgcagactccgtgaagggccgattcaccatctccagagacaatttccaagaacacgctgtatcctgcaaatgaacagcctgagagccgagacacggctgtgtattactgtgcgaggacatattgtaggtactacgccacctgctgtgggactactactacggtatggacgtctgggccaagggacggcacggtcccgtctcctcagcctccaccaagggcccatggtcttcccccctggccaccctcctcgcaagccctctggcggcacacggcggccctgggctgcctggtcaaggactacttcctatatactgtctgagcgggctggcaagggcgcatag

SEQ ID NO: 790329 - DNA, 710 bp, Homo sapiens
  misc_feature: 10739.UNK.UNK.UNK.pb.heavy.1.raw 10739
cgtatcgcctccctcgcgccatcagacagtatatacacgacgggtgctcgatttagtgctatagacttgggttggggagctctgggagaggagccagcaccagaagtcggcggtgtttccagtcggtgatcagcacgaacacagaggactcaccatggagtttgggctgacctgggtttctcgttgctcttttaagagtgtccagtgtcaggtgaagctggtggagtctggggaggcgtggtccagcctgggaggtcctgagactctcctgtgtagcgtctggattcaccttcaacagacatggcatgcactggtccgccaggctccaggcaaggactggagtggtgcacttatatggtatgatggaagtaataaatattatgtagatccgtgaaggccgattcaccatctccagagacaattcgaagaaccacactatatctggaaatgaatagcctgagagccgaggacacgctgtctactactgtgcgagagatgggctcgtggatacagatatgacatgctctactccaatggtatggacgcctgggccaagggaccacggtcgccgtctcctcagcctccaccaagggcccatcggtcttcccctggcaccctcctccaagagcacctctgggcacagcggccctggctgcctggtcaaggactacttcctatatactgtctgagcgggctggcaaggcgcatag

SEQ ID NO: 790330 - DNA, 700 bp, Homo sapiens
  misc_feature: 10752.44.73.G07.1.pb.heavy.1.raw 10752
ctatgcgccttgccagcccgctcagacagtatataggaagtagtccttgaccaggcagccagggccgctgtgctctcggaggtgctcctggagcagggcgccagggggaagaccgatgggcccttggtggaggctgaggagacggtgaccagtgtcccctggccccagtgaaacgcccgataatagctgctgccacttccgatctcgcacagtaatacagagccgagtcctcgcctctcaggctgatcatttccaggtacagagtgttccgggaattgtctctggagatggtgaatcggcccttcacggagtctgcataatatctagaagttccatcatatgctataactgccaaccactccggcccttgcctggagcctggcggaccagtgcatgccagaactactgaaactaaaatccagaggcttcacaggagagtctcagggacctcccaggctggaccacgcctcccccagactccacaggtgcacctgacactggacacctcttaaaagagtaacgaggaaaacccagctcagcccaaactccatggtgagtcctctgtgttcagtgctgatcaccgaatggaaacaccgccgacttctagtgctgggctcctctcccagagctcccctgagcgtagagctaaatcgagcaccggtcgtgtatatactgtctgatggcgcgaggaggcgatacg

SEQ ID NO: 790331 - DNA, 686 bp, Homo sapiens
  misc_feature: 10774.44.27.C05.1.pb.heavy.1.raw 10774
cgtatcgcctccctcgcgccatcagacagtatatacacgaccggtgctcgatttagacgcgatcgaagggtttgggggaagaggaagtcgccggtgtttccactcggtgatcatcactgaacacagaggactcaccatggagtttgggcctgagctgggttttcctcgttgcctcttaagaggtgtcatgtgtcaggtggcaattcgtggagtcctgggggaggcgtggccccagtagggggtccctgagactctcctgtgcagcctctggattcaccttcgataattggaatatgcagtgggtccgccaggctccaggcgaggggctggagtgggtgcaggtgtgtcatttcatggaggaaatcagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccaggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790332 - DNA, 729 bp, Homo sapiens
  misc_feature: 10786.UNK.UNK.UNK.pb.heavy.1.raw 10786
ctatgcgccttgccagcccgctcagacagtaatatataggaaagtagttccttgaccaggcagcccagggccgctgtgctctcggaggtgctcctggagcagggcgccagggggaagaccgatgggcccttggtggaggccgaggagacggtgaccaggttccctggccccaaggacgtcgaatgaaccgattttggaaaacagatagtttcccgcacaaaaattacaccggccgtgtttcctgaggttctcaggctgtttcattttgaagagacactgtgttctcggaattgttctctggagatggtgaatcggccctcaacggaatcaccgtagactttgatttcctccatgaaatgacacacctgccacccactccagcccctcgcctggagcctggcggaacccactgcatattccaattatcgaagtgaatccagaaggctgccaagcgagaagtctcagggacccccctactgggggccacgcctcccccagactccacgaattgcacctgaacacatgacacctcttaagaggggcaacgaggaaaacccagctcagcccaaaactccatggtgagtctctgtgttcagtgatgatcaccgagtgaaaacaccggcgacttcagtctgggctcgtctcccaggccccaaacccttcgatcgcgtctaaatcgagcaaccggtcgtgtatatactgtctgatggcgcgagggaggcgatacga

SEQ ID NO: 790333 - DNA, 647 bp, Homo sapiens
  misc_feature: 10792.UNK.UNK.UNK.pb.heavy.1.raw 10792
gatctatgcgccttgccagcccgctcagacagtataataggaagtagtccttgaccaggcagcccagggccgctgtgcccccagaggtgctcctggagcagggcgccagggggaagaccgatgggcccttggtgggaagctgaggagacagtgaccagggtgccacgccccatagattccaagaagaccagtctcgcctcgcacagaaataaacggccgtgtcccgcggcggtcaccggaggtcagtttcagggagaagcggttcatggacgtgtccctcgaaatggtgagagacgactcttggagggagcggagagtagtacgtcgccccagtataactggatgtcaccaatccactccattcccctccctgggggctgccggatccagccccaagaatgatcagaactgatggaaaactccagagacagtgcagatgagagacagggttcccgaaggcctcaccagtcctgggcccgactcctgcagctgcacctgggacaggacccatctgggagctgccaccagcaggaggaaaaaccacaggtgtgtcacgcccccctggccccaaatccctaatcacgtgtcctcaaatcgagccaccggtcgtgtatacatactgtctgatggcggcgggaggcgatacg

SEQ ID NO: 790334 - DNA, 649 bp, Homo sapiens
  misc_feature: 10799.44.23.C01.1.pb.heavy.1.raw 10799
cgtatcgcctccctcgcgccatcagacagtatatacacgaccggtgctcgatttagtacacgtgattagggattgggggcttctgagagtcaaggacctcctgtgcaagaacatgaagcacctgtggtttttcctcctgctggtggcagctcccagatgggtcctgtcccaggtgcagctgcaggagtcgggcccaggactggtgaggccttcggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggcgccgtggcaccctggtcactgtctcctcagcttccaccaagggccatcggtcttcccctggcgccctgctccaggagcacctctggggcacagcggccctgggctgcctggtcaaggactacttcctatatactgtctgagcgggctggcaaggcgcatag

SEQ ID NO: 790335 - DNA, 721 bp, Homo sapiens
  misc_feature: 10807.44.33.C11.1.pb.heavy.1.raw 10807
cgtatcgcctccctcgcgccatcagacagtatatacacgaccggtgctcgatttagagtgagctcgttgggtttggggctgggagaggagcccagcaccagaagtcgcggtgtttccagtcggtgatcagccacgaacacagaggactcaccatggagtttgggctgacctgggttttcctcgttgctttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagcgaggacacggctgtctactactgtgcgagagatgggctcgtggcatacagatatgacatgctctactccaatggtatggacgcctggggccaagggaccacggtcgccgtctcctcagcctccaccaagggcccatcggtcttccccctggcaccctcctccaagagcacctctgggggcacagcggcctggctgcctggtcaaggactacttcctatatactgtctgagcgggctggcaaggcgcatag

SEQ ID NO: 790336 - DNA, 680 bp, Homo sapiens
  misc_feature: 10819.44.45.E01.1.pb.heavy.1.raw 10819
ctatgcgcctgccaggccgctcagaccagtatataggaagtagtccttgaccaggcaggccagggccgctgtggctctcggaggtggctcctggaggagggccgccaggggaagaccgatgggcccttggtggaggctgaggagacggtgaccagggctccctggcccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttggcctggagcctggcggaccagtgcatgcagagtcactgaaactgagtcggacgcaacacaggagagtctcagggacgtcccaggctggaccacgcctccccagactccacagctgaacctgacactggacacctcttaaagagcaacgaggaaaacccagctcagcccaaactccatggtgagtcctctgtgttcagtgctgatcaccgaatggaaacaccgccgacttctagtgctgggctcctctcccaggcccctttcccttactgactcactaaatcgagcaccggtcgtgtatatactgtctgatggcgcgagggaggcgatacg

SEQ ID NO: 790337 - DNA, 682 bp, Homo sapiens
  misc_feature: 10831.44.45.E01.1.pb.heavy.1.raw 10831
ctatgcgccttgcccagcccgctcagacagtatataggaagtagtccttgaccaggcaggcccagggccgctgtgctctcggaggtgctcctggagcagggcgccaggggaagaccgatgggcccttggtgcaggctgaggagacggtgaccagggctccctggccccagtagaacgatgggctcgtacaataatagagagccgagtctcggctctcaaattgttcatttgtagatacacggtgttcttggaattgtctctggagacggagaatcggcccttcacggagtttccatagtattctttacttccatcagaccagatgactggccacccactccagcccttgcctggagcctggcggaccagtgcatggcagagtcactgaaactgagtccggacgcaacacaggagagtctcagggacgtcccaggctggaccacgcctcccccagactccaccagctgaacctgacactggacacctcttaaaagagcaacgagggaaacccagctcagcccaaactccatggtgagtcctctgtgttcagtgctgatcaccgaatggaaacaccgccgacttctagtgctgggctcctctcccaggccctttcccttactgactcactaatcgagcaccggtcgtgtatatactggtctgatggcgcgagggaggcgatacg

SEQ ID NO: 790338 - DNA, 705 bp, Homo sapiens
  misc_feature: 10852.44.55.E11.1.pb.heavy.1.raw 10852
ctatgcgccttgccagccgccgctcagacagtatataggaagtagtccttgaccaggcagcccagggccgctgtgccccagaggtgctcttggaggagggtgccaggggaagaccgatgggcccttggtggaggcggaggcgaccgtgaccagggttcctggccccagaagtcaaacgaataataaccactccgagcgccgacttgtctcgcacagtaatagacggccgtgtcgtcgcctctcaggttgttcatttgaagataaacgcgtgttcctggaattgtccctggagatggtgaatcgcccttcacggagtctgcgtagtatgtgaaatcaccagtataaatgactgagacccactccagccccttccctggagcctggcggacccaactcatgtagttgctgctgacggtgagcccagaggctgcacaggagagtctctgggacccccccaggctggactaaagcctcctccagactccatcagccgcacctcacactggacaccttttaaaagtccacaaggagaacccagctcagccaaaactccatggtgagtcctctgtgttcagtgctgatcaccgatggaaacacctcggaatcccagtgctgggctcctctcccccaaacccaacgtgcgagtgctaaatcgagcaccggtcgtgtatatactgtctgatggcgcgaggaggcgatacgatc

SEQ ID NO: 790339 - DNA, 686 bp, Homo sapiens
  misc_feature: 10877.44.74.G08.1.pb.heavy.1.raw 10877
ctatgcgccttgccagcccgctcagacagtatataggaagtagtccttgaccaggcagcccagggccgctgtgccccagaggtgctcctggagctgggcgccagggggaagaccgatgggcccttggtggaagctgaggtgacaatgaccagggttccctgccccagatctcaaaggctccatgcgagctggggtacggacctctcgcacagtagtagacggcgtgtcgtcggatttcaaagaactcattgtcatggagactgtgtctgtggacttgtccgcggtaatcgtaattctgccccggaagtccgtgcgtaggagtgagccaaaaagagggatgattcacccatccactcaagcccttgtccaggcctggcgcacccagttgatggtataagtagtggaactggtagtacttccagaggccgtgcaggaaaaggtcaccggaggaccaagttgcggcattctagtcccagactgcaccagttgcaccagggactggacacctgttgctgctgccaccacaaagaggaacctccaggtccagtccatggtgatgagctgtgctcccaggggcttctttagaggaggaatgtggttgttatgtgatgctccccctgatagagctactaaatcgagcaccggtcgtgtatatactgtctgatggccgcgagggaggcgatacg

SEQ ID NO: 790340 - DNA, 654 bp, Homo sapiens
  misc_feature: 10880.44.86.H09.1.pb.heavy.1.raw 10880
ctatgcgccttgccagccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 790341 - DNA, 680 bp, Homo sapiens
  misc_feature: 10892.UNK.UNK.UNK.pb.heavy.1.raw 10892
ctatgcgccttgcagccggtcagacagtatataggaagtagtccttgaccaggcagcccaggccgctgtgcccccagaggtgctcctgagcagggcgccagggggaagaccgatggcccttgtggaagctgaagagacggtgaccattgtccctggccccaaatatcaaatgcatcgacgccccaggatgcctggcgcagtatagacgcctgtgtcgtcgggtctcaggttgctcatttgtaaatggccaacacaagctgtggagtcatcccttgagacggtgaatcttcccttcacagacgcggcgtactctttactccaaccataacgtttcattcgacgaaagtgatccactcaagccccttccctggagcctgacggacccaggccagtgataatcactaaggactgaatctgagactacacagagagtctcagagaccgccctggctgtgccaagccccccccgactccgccagtcgcccctcgcactgacaccttctaaaaaactacaaggaaaatcaagattagccaaactccatggttggtggtctgtgctcagtgctgatcaccaagtggaaactcctgggaatctcacgctgggctcctctctcttgcgacgacctaaatcgagcaccggtcgtgtaatatactgtctgatggcgcgaggaggcgatacg

SEQ ID NO: 790342 - DNA, 653 bp, Homo sapiens
  misc_feature: 10936.44.86.H09.1.pb.heavy.1.raw 10936
cgtatcgcctccctcgcgccatcagacagtatatacacgaccggtgctcgatttagtgctatagacttggtttggggatgctttctgagagtcaaggacctcctgtgcagagaacatgaagcactgtggtttttcctcctgctggtggcagctcccagatggtcctgtcccaggtgcagctgcaggagtcggcccaggactggtgagcccttcgggaaccctgtctctcatctgcactgtctctggagtttccatcagttctgatcattcttggggctggatcggcagcccccagggagggaatggagtggattggtgacattcattatactggggcgacgtactactctccgtccctcaagattcgtctcaccatttcgaggacacgtccatgaaccgcttctccctgaaactgacctccgtgaccgccgcggacacggccggttttatttctgtgcgagggcgagactggtctttcaatctatggggccgtggcaccctggtcactgtctcctcagcttccaccaagggcccatcggttcttccccctggcgccctgctccaggagcacctctgggggcacagcgggccctgggctgcctgtcaaggactacttcctatatactgtctgagcgggctggcaaggcgcatag

SEQ ID NO: 790343 - DNA, 657 bp, Homo sapiens
  misc_feature: 10952.44.86.H09.1.pb.heavy.1.raw 10952
ctatgcgccttgccagcccgctcagacagtatataggaagtagtccttgaccaggcagcccagggccgctgtgcccccagaggtgctcctggagcaggggcgccagggggaagaccgatgggccgccttggtggaagctgaggagacagtgaccagggtgccacggccccatagattgaaagaccaagtctcgcctcgcacagaataaacggccgtgtccgcggcggtcacggaggtcagtttcagggagaagcggttcatggacgtgtccctcgaaatggtgagacgactcttgaggacggagagtagtacgtcgccccagtataatggatgtcaccaatccactccattcccctccctgggggctgccggatccagcccaagaatgatcagaactgatggaaactccagagacagtgcagatgagagacagggttcccgaaggcctcaccagtctgggcccgactcctgcagctgcaccttgggacaggacccatctgggagctgccaccagcaggaggaaaaaccacaggtgcttcatgttcttgcacaggaggtccttgactctcagaaagcatcccccaaacccaagtctatagcactaaatcgagcaccggtcgtgtatatactgtctgatggcgcgagggaggcgatacg

SEQ ID NO: 790344 - DNA, 722 bp, Homo sapiens
  misc_feature: 10964.44.85.H08.1.pb.heavy.1.raw 10964
ctatgcgccttgccagcccgctcagacagtataggaagtagtccttgaccaggcagcccagggccgctgtgccccagaggtgctcttggaggagggtgccaggggaagaccgatggcccttggtggaggctgaggagacggtgaccgtggttcccttggccccagacgtccataccgtagtagtagtcccagcaggtggtagtaactacaatatgtcctcgcacagtaatacacagccgtgtctcggctctcaggctgttcattttgcagatacagcgtgttcttggaattgtctctggagatggtgaatcggccctttcacggagtctgcatagtatttattacttccatcataccatataagtgccacccactccagccccttgcctggagcctggcggacccagtgcatgccataggttactgaaggtgaatccagacgctgcacaggagagtctcagggacctcccaggctggaccacgcctccccagactccaccagctgcacctgacactggacacctcttaaaaagagcaacgaggaaaaacccagctcagcccaaactccatggtgagtcctctgtgttcagtgctgatcaccgaatggaaacaccggccgacttctagtgctggctcctctccagagctccccgcgactgagtgatactaaatcgagcaccggtcgtgtatatactgtctgatggcgcgagggaggcgatacg

SEQ ID NO: 790345 - DNA, 651 bp, Homo sapiens
  misc_feature: 10984.44.86.H09.1.pb.heavy.1.raw 10984
cgtatcgcctccctcgcgccatcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtggaggccttcgggaaccctgtctctcatctgcactgtctctggagtttccatcagttctgatcattcttggggctggatccggcagcccccaggggagggaatggagtggattggtgacatccattatactggggcgacgtactactctccgtccctcaagagtcgtctcaccatttcgagggacacgtccatgaaaccgcttctccctgaactgacctccgtgaccgcgcggacacggccgtttatttctgtgcgaggcgagactggtctttcaatctatggggccgtggcaccctggtcactgtctcctcagcttccaccaagggcccatcgtcttcccctggcggcctgctccaggagcactctgggggcacagcggccctgggctgcctggtcaaggactacttcctatatactgtctgagcgggctggcaaggcgcatag

SEQ ID NO: 790346 - DNA, 690 bp, Homo sapiens
  misc_feature: 11012.44.36.D03.1.pb.heavy.1.raw 11012
ctatgcgccttgccagcccgctcagacagtatataggaagtagtccttgaccaggcagcccagggcgctgtgctctcggaggtgctcctgagcagggcgccaggggaagaccgatgggcccttggtggaggctgaggagacggtgaccagggttccctggcccagtggacagttcctgatataaacacaacacaataatacatgcccgtgtcctcggttttcaggttagtcattcgcagaatcaatgagttcttgaagtcatctcttgagagggtgaatctggcttcacagacgcggcgtactctgtgataaagctggcaactttgttttttactgcggccagccactccagcccttccctggagcctggcggacccagtccatatagtggtcactgatggtgaatcagaggcgacacaggagagtctcaggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctgggctccgctctcccccaagagagatcgtgacgcagctaaatcgagcaccggtcgtgtatatactgtctgatggcgcgagggaggcgatacg

SEQ ID NO: 790347 - DNA, 699 bp, Homo sapiens
  misc_feature: 11016.44.36.D03.1.pb.heavy.1.raw 11016
cgtatcgcctccctcgcgccatcagacagtatatacacgaccggtgctcgatttagctgcgtcacgatctctcttgggagctctgagagcggagccccagccccagaattccaggtgttttcatttggtgatcagcactgaacacagaggactcaccatggagttcgggctgagctgggtttccttgtttttattttacaaggtgtccagagtgaagtgcagttggtggagtccggggagacttggtccagcctggagggtccctgagactctcctgtgtcgcctctggattcaccatcagtgaccactatatggactgggtccgcaggctccagggaaggggctggagtggcttggccgcagtaaaacaaagttgccagctttatcacagagtacgccgcgtctgtgaaagccagattcaccctctcaagagatgacttcaagaactcattgattctgcgaatgactaacctgaaaaccggaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcggctggcaaggcgcatag

SEQ ID NO: 790348 - DNA, 715 bp, Homo sapiens
  misc_feature: 11042.UNK.UNK.UNK.pb.heavy.1.raw 11042
ctatgcgccttgccagcccgcctcagacagtatataggaagtagtccttgaccaggcagcccagggccgctgtgctctcggaggtgctcctgaggcaggggcgccagggggaagaccgatgggccccttggtggaggctgaggagacggtgaccagggtccccctggccccagtcatgcggcccggtaataactactaccacctcccgatctcgcacagtaatacagagccgagtcctcgactctcaggctgaccatttccaagtacacaatgttccgggaattgtctctggagatggtgaatcggcccttcacgggagtctgcataatattcagaacttccatcatgtgctataactgccaaccactccggcccccttgcctggagcctggcggacccagtgcatgccagaaccactgaaactaaatccagaggcttcacaggagagtctcagggacctcccaggctggaccacgctcccccagactccaccaggtgcacctgacagtggacacctcttaaaagagcaacgaggaaaacccagctcagcccaaactccatggtgagtcctctgtgttcagtgctgatcaccgaatggaaacaccgccgacttctagtgctgggctcctctcccagacccctttcccttcacactacactaatcgaggcaccggtcgtgtatatactcgtgctgatggcggcgggaggcgatacg

SEQ ID NO: 790349 - DNA, 582 bp, Homo sapiens
  misc_feature: 11050.UNK.UNK.UNK.pb.heavy.1.raw 11050
cgtatcgcctcctcgcgccatcagaccagtaatacacaccccccggtgctcgattgtgtgagttagtttgggttggggggaagaggaagactgacggtccactcgaggtagctgggcgtctgggggctgagggtgagaagcctggggccccagtgacagtctcctgcacggcttctggatacacgttcatcaattatgatatttaactgggtgcgacaggccgctggacaagggctggagtggatgggatggatgaagccctatagtggcaacacgggctttgccagaagttccaaggcagagttagtatgaccaggagcacctccccaggtacagtctacatggaactgagcagcctgagatctgaggaccacggccgtgtatttctgttgcgagagccaccagcacctggcttgacttgtggggccagggacgcctgcgtcacggtctcctcagcctccacaagggccatcggtcttccccctggcgcgctccaggagcacctcgagagcacagcggccctggctgcctggtcaagactacttcctatatactgtctgagcgggctggcaaggcgcatag

SEQ ID NO: 790350 - DNA, 699 bp, Homo sapiens
  misc_feature: 11069.UNK.UNK.UNK.pb.heavy.1.raw 11069
ctatgcgccttgccagcccgctcagacagtatataggaagtagtccttgaccaggcagcccaggccgctgtgccccagaggtgctcttggaggagggtgccagggggaagacgatgggcccttggtggaggcggaggcgacggtgaccagggttccctggcccagaagtcaaacgaataaataaccactccgagcgccgacttgtctcgcacagtaatagacgccgtgtcgtcgcctctcaggttgttcatttgaagataaaccgtgttcctggaattgtccctggagatggtgaatcggcccttcacggagtctgcgtagtatgtgaatcaccagtataaatgactgagaccactccagccccttccctggagcctggcggacccaactcatgtagttgctgctgacggtgagcccagaggctgcacaggagagtctctgggaccccccaggctggactaagcctcctccagactccatcagccgcacctcacactggacacctttttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaaatcgagcaccggtccgtgtatatactgtctgatggcgcgagggaggcgatacg

SEQ ID NO: 790351 - DNA, 725 bp, Homo sapiens
  misc_feature: 11080.UNK.UNK.UNK.pb.heavy.1.raw 11080
cgtatcgcctccctcgcgccatcagacagtatatacacgaccggtgctcgatttagtatcactccagtcgcggggagctctggagaggagcccagcactagaagtccggcggtgtttccattcggtgatcagcactgaacacagaggactcaccatggagtttgggctgagcgggttttcctcgttgctcttttaagaggtgtccagtgtcaggtgcagctgtgggagtctgggggaggcgtggtccagcctgggaggtccctgagactctcctgtgcagcgtctggattcaccttcagtacctatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctggggactactactacggtatggacgtctggggccaaggggaccacggtcaccgtctcctcagcctccaccaagggcccatcgtcttccccctggcaccctcctccaagagcacctctgggggcacagcggccctgggctgcctggtcaaggactacttcctatataactgtctgagcgggctggcaaggcgcatag

SEQ ID NO: 790352 - DNA, 592 bp, Homo sapiens
  misc_feature: 11111.UNK.UNK.UNK.pb.heavy.1.raw 11111
aggctgggcaggctatgcaccctggtccaggtcaaaagctgcgaacccgctagcggccatcttggcactagggtcccgcagattcatattgtcgtctagcatgcacatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactcacttccggaagttcaactcatccaacacgaaataaagtaaactcaacaccccaagcaggctatgtgggggcgtgataggggtggattctatttcctatcccatccctaggatctcattaagttactagcgagttaaatgtctgtagcgatccgtcagtcctatcgcgcgcatcaagacctggttggttgagcgtgcagtagatcatcgataagctgcgagttaggtcatccagaccgcatctggcgcctaaacgttcagtggtagctaaggcgtcaccttcgactgtctaaaggcaatatgtcgtcctagctccaagtccctagcaagcgtgtcgg

SEQ ID NO: 790353 - DNA, 704 bp, Homo sapiens
  misc_feature: 11164.44.56.F01.1.pb.heavy.1.raw 11164
ctatgcgccttgccagcccgctcagacagtatataggaagtagtccttgaccaggcagccaggcgccgctgtgccccagaggtgctcctggagcagggcgccagggggaagaccgatgggccctgtggaagctgaagagacggtgaccattgttcctggccccaaatatcaaatgcatcgacgtcccaggatcgcctggcgcagtaatagacgcctgtgtcgtcggtctcaggttgctcatttgtaaatggccaacactgttggagtcatcccttgagacggtgaatcttcccttcacagacgcggcgtactcttacttccaccataacgtttcattctgacgaaagtgatccactcaagccccttccctggagcctgacggacccaggcaagtgataatcactaagactgaatcctgagactcacaggaagagtctcagagaccgccctggctgtgccaagcccccccccgactccgccagtcgcccctcgcactggacaccttctaaaaaaacacaaggaaaacaagatagcccaaactccatggttggtggtctgtgctcagtgctgatcaccaagtggaaactcctgggaaatctcacggctggggctcctctcccagagctccctttgtgtgttcagacgtctgctaatcgagcaccggtcgtgtatatactgtctgatggcgcgagggaggcgatacg

SEQ ID NO: 790354 - DNA, 654 bp, Homo sapiens
  misc_feature: 11182.44.86.H09.1.pb.heavy.1.raw 11182
cgtatcgcctccctcgcgccatcagacagtatatacacgaccggtgctcgatttagtgctatagacttggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccccagggaggggaatggagtggattggtgacatccattatactggggcgacgtactactctccgtcctcaagagtcgtctcaccatttcgagggacacgtccatggaaccgcttctccctgaaactgacctccgtgaccgccgcggacacggccgtttatttctgtgcgaggcgagactggtctttcaatctatggggccgtggcaccctggtcactgtctcctcagcttccaccaagggccatcggtcttccccctggcgccctgctccaggagcacctctgggggcacagcggccctgggctgcctggtcaaggactacttcctatatactgtctgagtgggctggcaaggcgcatag

SEQ ID NO: 790355 - DNA, 694 bp, Homo sapiens
  misc_feature: 11190.44.74.G08.1.pb.heavy.1.raw 11190
cgtatcgcctccctcggcgccatcagacagtatatacacgaccggtgctcgatttagtagctctatcagggggagcatcacataacaaccacattcctcctctaaagaagccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatcctctttttggctcactcacctacgcacgagacttccggggcagaattacgattaccgcggacaagtccacagacacagtctccatgacaatgagttctttgaaatccgacgacacggccgtctactactgtgcgagaggtccgtacccccagctcgcatggagcctttgagatctgggggcagggaaccctggtcattgtcacctcagcttccaccaagggcccatcggtcttccccctggcgccctgctccaggagcacctctggggcacagcggccctgggctgcctggtcaaggactacttcctatattactgtctgagcgggctggcaaggcgcatag

SEQ ID NO: 790356 - DNA, 641 bp, Homo sapiens
  misc_feature: 11209.44.57.F02.1.pb.heavy.1.raw 11209
cgtatcgcctccctcgcgccatcagacagtatatacacgaccggtgctcgatttagctcgatatagttgggtttgggatgctttctgagagtcaagacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggagggaatggagtggattggtgacatccattatactgggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggccgtggcaccctggtcactgtctcctcagcttccaccaagggcccatcggtcttcccctggcgccctgctccaggagcacctctgggggcacagtggccctggctgcctggtcaaggactactatactgtctgagcgggctggcaaggcgcatag

SEQ ID NO: 790357 - DNA, 673 bp, Homo sapiens
  misc_feature: 11223.UNK.UNK.UNK.pb.heavy.1.raw 11223
cgtatcgcctccctcgcgccatcagacagtatatacacgacggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctggggaggcgtggtccagcctggacgtccctgagactctcctgtgttgcgtccggactcagtttcagtgactctgccatgcactgggtccgccaggctccaggcaagggctggagtgggtggcagtcatctgtctgatggaagtaaagaatactatggaaactccgtgaagggccgattctccgtctccagagaccaattccaagaacaccgtgtatctacaaatgaacaatttgagagccgaggactcggctctctattattgtacgagcccatcgttctactggggccagggagccctggtcaccgtctcctcagcctccaccaagggccatcggtcttcccctggcgccctgctccaggagcacctccgagagcacagcgccctgggctgcctggtcaaggactacttcctatatactgtctgagcgggctggcaggcgcat

SEQ ID NO: 790358 - DNA, 713 bp, Homo sapiens
  misc_feature: 11248.44.39.D06.1.pb.heavy.1.raw 11248
gccagcccgctcagacagtatataggaagtagtcccttgaccaggcagcccagggccgctgtgccccagaggtgctcctggagcagggcgccagggggaagaccgatggcccttggtggaagctgaggagacggtgaccgacgtcccctgccccagacatccatcaaatagtagtagtttatgattccccgaacgtttccttggaggtccccctccgcacagtaataaacagacgtgtcgtcaactctcacgctgttcatttgcaaatacagcatattcttggaattgtctctggagatggtgaatcggcccttcacggagtctgagtaatacttctcacttccatcgtcggagatgactgccacccactccggcccttgcctggagcctggcggacccagtgcaaaccaaatctatcgaatgagaacccagaggctacacaggagagtctcagggacctccggggctggaccacgctcccccagactccaccaagtgctcctgacactggacacctctttaaaagagcaacgaggaaaacccagctcagcccaaactccatggtgagtcctctgtgttcagtgatgatcaccgaatggaaacaccggcgacttccagtgctggctcgtctctcccccaaagaactgcgagatgtcactaaatcgagcaccggtcgtgtatatactgtctgatggcgcgagggaggcgatacg

SEQ ID NO: 790359 - DNA, 576 bp, Homo sapiens
  misc_feature: 11250.44.36.D03.1.pb.heavy.1.raw 11250
cgtatcgcctcccctcgcgccatcagacagtatatacacgaccggtgctcgatttagctgcgtcacgatctctcttggggacccagcttctgatgactctcctgttgccagcgtccatggcctcagtgaaggtctcctgcaaagctctggatacaccttcgccagctacgacattcactgtgtgtgacaggccctggataagggtttgaatggatggtagggagctactctggcaatggtaacacaggctatgcacagaagtttcagggcagagtcaccatgaccagggacacgtccacgagcacagcctacatggagctgagcagtcagagatctgaggacatagatgtgtactactgtgcgagaccggtagaggacaagcaagaaaagaagttcttttgactactggggccagggaaccctggtcaccgtctcctcagcctccaccaagggcccatcggtcttccccctggcacccctcctccaagagcacctctgggggccacagcggccctgggctgcctggtcaaggactacttcctatatactgtctgagcgggctggcaaggcgcatag

SEQ ID NO: 790360 - DNA, 709 bp, Homo sapiens
  misc_feature: 11256.44.55.E11.1.pb.heavy.1.raw 11256
cgtatcgcctcctcgcgccatcagacagtatatacacgaccggtgctcgatttagcactcgcacgttgggtttggggagaggagcccagcactgggattccgaaggtgttttcccattcggtgatcagcactgaacacagaggactcaccatggagttttggctgagctgggttctccttggttggacttttaaaaaggtgtccagtggtgaggtgcggctgatggagtctggaggaggcttagtcccagcctggggggtcccagagactcctcctgtgcagcctctgggctcaccgtcagcagcaactacatgagttgggtccgccaggctccagggaaggggctggagtgggtcctcagtcatttatactggtgatttcacatactacgcagactccgtgaagggccgattcccatctccagggacaattccaggaacacggtttatcttcaaatgaacaacctgagaggcgacgacacggccgtctattactgtgcgagacaagtcggccgctcgagtggttattattcgtttgacttctggggccagggaaccctggtcaccgtcgcctccgcctccaccaagggcccatcgtcttccccctggcaccctcctccaagagcacctctgggggcacagcggccctgggctgcctggtcaaggactacttcctatatactgtctgagcgggctggcaaggcgcatag

SEQ ID NO: 790361 - DNA, 571 bp, Homo sapiens
  misc_feature: 11283.44.78.H01.1.pb.heavy.1.raw 11283
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggccccacaagtcaagccaggtgctggtggctctcgcacagaaatacacggccgtgtcctcagatctcaggctgctcagttccatgtagactgtacctgggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggcttcttcacctcagcagcgtggtgaccgtgacctccagcaacttcggcacccaaacccaaactactcacactaaatcgagcaccggtcgtgtatatactgtctgatggcgcgagggaggcgatacg

SEQ ID NO: 790362 - DNA, 665 bp, Homo sapiens
  misc_feature: 11312.UNK.UNK.UNK.pb.heavy.1.raw 11312
ctatgcgcctgccagcccgctcagacagtatataggaagtagtccttgaccaggcagcccagggccgctggtggccccagaggtgctcctggagcagggcgccagggggaaagaccgatgggcccttgggtggaagctgaggagacagtgaccagggttgcccacggccccatagattgaaagacagtctcgcctcgcacagaaaataaacggccgtgtccgcggcggtcacggaggtcagttttcagggagaaagcggttcatggacgtgtccctccgaaatggtgagacgactcttgagggacggagagtagtacgtcgccccagtataatggatgtcaaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacagggacccatctgggagctgccaccagcaggaggaaaaaccacagtgcttcatgttcttgcacaggaggtccttgactctcagaaagcccccaatcccctaatcacgtgtactaaattcgaagcaccggtcgtggtatatactgtctgatggcgcggaggaggcgatacg

SEQ ID NO: 790363 - DNA, 612 bp, Homo sapiens
  misc_feature: 11318.44.23.C01.1.pb.heavy.1.raw 11318
cgtatcgcctccctcgcgccatcagacagtatatacacgaccggtgctcgatttagtacacgtgattagggattggggcagggtgaacacctgtggtttttcctcctgctggtggcagctcccagatgggtcctgtcccaggtgcagctgcaggagtcggcccaggactggtgaggccttcgggaaccctgtctctcatctgcactgtctctggagtttccatcagttctgatcattcttggggctggatccgcagcccccagggagggaatgagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttcccctggcgccctgctccaggagcacctctgggggcacagcggccctgggctgcctggtcaagggactacttcctatatactgtctgagcgggctggcaaggcg

SEQ ID NO: 790364 - DNA, 609 bp, Homo sapiens
  misc_feature: 11325.UNK.UNK.UNK.pb.heavy.1.raw 11325
tctatgccgccttgccagcccgctcagacagtatataggaagtaagtccttgaccaggcagccaggggccgctgtggctctcggaggtgcccctggagcagggcggccagggggaaagaccgatgggccctttggtggaggctgaggagacggttgaccagggtttttccctggccccacaagtcaagccaggtgctggtgctctcgcacagaaatacacggccgtgtcctcagatctcaggctggcctcagttccatgttagaactgttacctggggaggtgctcctggtcatactaactctgccttggaaactttctgggcaaaagcccgtgtttgcccactatagggcttcatccacccatccactccaggccctttgtccagcggcctgtcgcacccagtttaatatcataattgatgaaaacgtgtatccagaagccgtgcaggaagactgtcactgaggccccaggcttcttcacctcaggccagcgtggtgaccgtgacctccagcaacttcggccacccaaaacccaaaactactcaacactaaaatcgagcaccggtcgtgtaatattactgttctgatggcgcgaagggaggcgatacg

SEQ ID NO: 790365 - DNA, 603 bp, Homo sapiens
  misc_feature: 11328.44.36.D03.1.pb.heavy.1.raw 11328
cgtatcgcctccctcgcgccatcagacagtatatacacgaccggtgctcgatttagctgcgtcacgatctctcttggtcttgtcccaggtcaccttgaaggagtctggtcctgtgctggtgaaacccacagagaccctcacgctgacctgcaccatctctgggttctctctcaacgatattagaatgggtgtgagctggatccgtcagccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggaaacaggcacatattactgtgcacggtaatgcgggaaagaaacagctggtttctgtattataagtcttaccatctggacgtctgggcaaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 790366 - DNA, 598 bp, Homo sapiens
  misc_feature: 11331.UNK.UNK.UNK.pb.heavy.1.raw 11331
ctatgccgccttgccagcccgctcagacagctatatagggagtagtgccgttgaccagggcagccccagggcgccgctgtgcctcggaggtgctcctgagcagggcgccagggggaagaccgatggccttggtggaggctgaggagacgcgtgaccagcggttccctggccgcccacaagtcaagccaggggctggtggctctcgcacagacaatacacggcgtgtcctccgatctcaggctgctcagtttcgcatgtagactgtaccctggggaggtgctcctgggcatactaactctgccttggaacttctgggcaaagcccgtcggttggcactatagggcttcatccatccatccaactccagcccttgtcccagcggcctgtcgcaccccagttaatatcataattcgatgaacgtgtatccagaagccgtgcaggagactgtcactgaggccccaggcttcttcacctcagcagcgtggtgaccggtgacctccagcaacttcggcacccaaccaaacccaactactcacactaaatcgagccccgccgtcgcgtgtatatactggtctgatggcgcgagggaggcgatacg

SEQ ID NO: 790367 - DNA, 653 bp, Homo sapiens
  misc_feature: 11336.44.53.E09.1.pb.heavy.1.raw 11336
ctatgcgccttgccagcccgctcagacagtatataggaagtagtccttgaccaggcagccagggccgctgtgctctcggaggtgctcctggagcagggcgccaggggaagacgatgggcccttggtggaggctgaggatgaggagacggtgaccgtggtcccttggccccagacgtcccaagcgtagtagaattgagacgacctgccataggcggacccatgtctgacacagtagtagacagccgtgtcggcggcggccacagaactcactttcagggaaaactgtgtcctcgacgtgtccacggatatggtgactcgaccgttgagggacgggttgtagtaggtgttcccactataatagagactcccaatccactgcagcccctctcctgggggctggcggatccagccccagtagaaattacttctgtcgatggaggcaccagagaccgtgcacgtgagggacagggtctccgaaggcttcaccagtcctgggcccgactcccgcagctgcggctgagacaggacccatctgggagccgccaccagcaggaggaagaaccacaggtgcttcccccaaaacccaacacactctctctaaatcgagcaccggtcgtgtatatactgtctgatggcgcgagggaggcgatacg

SEQ ID NO: 790368 - DNA, 726 bp, Homo sapiens
  misc_feature: 11348.44.55.E11.1.pb.heavy.1.raw 11348
cgtatcgcctccctcgcgccatcagacagtatataacacgaccggtgctcgatttagcactcgcacgttgcggtttggggggggagagagcccagcactgggattccgaggtgtttccattcggtgatcagcactgaacacagaggactcaccatggagttttggctgacggcgggggttctccttgttggacttttaaaaaggtggtccaggtgtgagtgaggctgatggagtctggaggaggcttagtccagcctggggcgtcccagagacctcctgtgcagcctctgggctcaccgtcagcagcaaactacatgagtgggttccgccaggctccagggaaggggctggagtggggtctccaagtcatttatactggtgatttcacatactacgcagactccgtgtacagccagggccgcgattcaccatctccagggacaattccaggaacacggtttatcttcaaaatgaacaacctgagaggcgacgacacggccgtctattactgtgcgagacaagtcggcggctcggagtggttattattcgtttgacttctggggccagggaaccctggtcaccgtcgcctccgcctcaccaagggcccatcggtcttccccctggcaccctcctccaagagcacctctggggcacagcggccctgggctggcctggtcaaggactacttcctatatactgtctggagcgggctggcaaggcgcatag

SEQ ID NO: 790369 - DNA, 653 bp, Homo sapiens
  misc_feature: 11349.44.86.H09.1.pb.heavy.1.raw 11349
cgtatcgcctcctcgcgccatcagacagtatatacacgaccggtgctcgatttagtgctatagacttggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtgcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 790370 - DNA, 701 bp, Homo sapiens
  misc_feature: 11369.44.55.E11.1.pb.heavy.1.raw 11369
cgtatcgcctccctcgcgccatcagacagtatatacacgaccggtgctcgatttagcactcgcacgttgggtttggggagaggagcccagcactggatccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtccccagagactctcctgtgcagcctctgggctcaccgtcagcagcaactacatgagttgggtccgacaggctccaggaaggggctggagtgggtctcagtcatttatactggtgatttcacatctacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctgggggccagggaaccctggtcaccgtcgcctccgcctccaccaagggcccatcggttctccccctggcacccctcctcaagagcacctctgggggccacagcggcctggctgcctggtcaaggactacttcctatatactgtctgagcgggctggcaaggccgcatag

SEQ ID NO: 790371 - DNA, 651 bp, Homo sapiens
  misc_feature: 11370.44.23.C01.1.pb.heavy.1.raw 11370
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaagaccagtctcgcctcgcacagaaataaacggccgtgtccgcggcggtcacggaggtcagtttcagggagaagcggttcatggacgtgtccctcgaaatggtgaggacgactcttgagggacggagagtagtacgtcgccccagtataatggatgtcaccaatccactccattcccctccctgggggctgccggatccagccccaagaatgatcagaactgatggaaactccagagacagtgcagatgagagacagggttccgaaggcctcaccagtcctgggccggactcctgcagctgcacctgggacaggacccatctgggagctgccaccagcaggaggaaaaaccacaggtgcttcatgttcttgcacaggaggtccttgactctcagaaagcccccaatccctaatcacgtgtactaaatcgagcaccggtcgtgtatatactgtctgatggcgcgaggaggcgatacg

SEQ ID NO: 790372 - DNA, 707 bp, Homo sapiens
  misc_feature: 11383.44.36.D03.1.pb.heavy.1.raw 11383
cgtatcgcctccctcgcgccatcagacagtatatacacgaccggtgctcgatttagctgcgtcacgatcttctctggggagctctgagagcggagccccagccccagaattccaggtgttttcatttggtgatcagcactgaacacagagactaccatggagttcggggctgagctggggtttccttgttgttattttacaaggtgtccagagtgaagtgcagttggtggagtccggggagacttggtcagcctggagggtccctgagactctcctgtgtcgcctctgggattcaccatcagtgaccacatatgggactgggtccgccaggctccagggaaggggctggagtggcttggccgcagtaaaaacaaagttgccagctttatcacagagtacgccgcgtctgtgaaagccagattcaccctctcaagagatgacttcagaactcatgattctgcgaatgactaacctgaaaaccgaggacacggcatgtattattgtgttgtgttttatatcaggaactgtccactggggccagggaaccctggtcaccgtctcctcagccctcccaccaaggcccatcggtctttcccctggcgccctgctccaggagcaccctccgagagcacaggcggccctgggctgcctggtcaaggacttactttcctatatactgtcttgagcgggctggcaagcggcaatag

SEQ ID NO: 790373 - DNA, 694 bp, Homo sapiens
  misc_feature: 11469.44.36.D03.1.pb.heavy.1.raw 11469
tcgtatcgcctccctcgcgccatcagacagtatatacacgaccggtgctcgatttagctgcgtcacgatctctcttgggggagagcggagccccagcccagaattcccaggtgttttcattggtgatcagcactgaacacagaggactcaccatggagttcgggctgagctgggtttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgcgcgtctgtgaaagccagattcaccctctcaagagatgacttcaagaactcattgattctgcgaatgactaacctgaaaaaccgaggacacgggcatgtattattgtgttgtgtttatatcaggaactgtccactggggccagggaaccctggtcaccgtctcctcagcctccaccaaggggccatcggtcttcccctggcgccctgctccaggagcacctccgagagcacagcggccctgggctgcctggtcaaggactacttcctactgtctgagcgggctggcaaggcgcatag

SEQ ID NO: 790374 - DNA, 692 bp, Homo sapiens
  misc_feature: 11471.UNK.UNK.UNK.pb.heavy.1.raw 11471
cgtatcgcctcctcggcgcatcagacagtatatacacgaccgggtggctcgatttagcactcgccacgttggtttgggggggggagaggagcccagcactggattccgaggtgtttccattcggtgatcagcactgacacagaggactcaccatggagttttggctgagctgggttctcctgttggacttttaaaaggtgtccagtgtgaggtgggctgatggagtctggaggagggcttagtccagcctggggtccgagcgtctcctgtgcagctctgggctcaccgtcagcagcaactacatgagttgggtccgccaggctccagggaaggggctggagtgggtctcagtcatttatactggtgatttcacatactacgcagactccgtgaagggccgattcaccatctccagggacaattcaggaaccacggtttatcttcaaatgaaaactgagaggcgacgacaacggccgtctattactgtgcgagacaagtcggcgctcgagtggttattattcgtttgacttctggggccagggaacctggtcacccgtcgcctccgctccaccaagggccatcggtcttccctggcaccctcctccaagagcacctctggggcacagcggccctgggcctgcctggtcaagactacttcctatatactgtctgagcggctgcaaggcgcatag

SEQ ID NO: 790375 - DNA, 649 bp, Homo sapiens
  misc_feature: 11520.44.23.C01.1.pb.heavy.1.raw 11520
cgtatcgcctccctcgcgccatcagacagtatatacacgaccggtgctcgatttagtacacgtgattagggattgggggctttctgagagtcaaggacctcctgtgcaagaacatgaagcacctgtggtttttcctcctgctggtggcagctcccaagatgggtcctgtcccaggtgcagctgcaggagtcgggcccaggactggtgaggccttcggaaccctgtctctcatctgcactgtctctggagtttccatcagttctgatcattcttggggctggatcgcagcccccaggggaggggaatggagtggattggtgacatccattatactgggcgacgtactactctccgtccctcaagagtcgtctcaccatttcgagggacacgtccatgaaccgcttctcctgaaactgacctccgtgaccgccgcggacacggccgtttatttctgtgcgaggcgagactggtctttcaatctatgggccgtggcaccctggtcactgtcctcctcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 790376 - DNA, 616 bp, Homo sapiens
  misc_feature: 11538.44.38.D05.1.pb.heavy.1.raw 11538
cgtatcgcctccctcgcgccatcagacagtatatacacgaccggtgctcgatttagtatctgatagctgggtttccttgttgctattttaaaaggtgtccagtgtgaggtgcagctgtggagtccgggggagcttagttcagcctgggggtccctggagactctcctgtgcagcctctggattcaccttcagtagctactggatgcactggtccgccaagctccagggaagggggctgggtgtgggtctcacgtattaatagtgatgggagtagcacaagctacgcggactccgtgaagggccgattcaccatctccagagacaaacgccaagaacacgctgtatctgcaaatgaacagtctgagagccgaggacacggctgtgtattactgtgcaagagccggtgcgggagttcggggagttgcatactactacttacggtatggacgtctggggccaagggaccacggtcaccgtctcctcagcttccaccaagggcccatcggtcttcccctggcgccctgctccaggagcacctctggggcacagcggcctgggctgcctggtcaaggactacttcctatatactgtctgagcgggctggcaaggcgcatag

SEQ ID NO: 790377 - DNA, 604 bp, Homo sapiens
  misc_feature: 11540.UNK.UNK.UNK.pb.heavy.1.raw 11540
gaaggctgggcaggctatgcaccctggtccaggtcaaaagctgcggaacccgctagcggccatcttggccactaggggtccgcagattcatattgtcgtctagcatgcacaaatgctgcaacccagcttgcaatgcccacagcaagcggccaatctttacgccacgttgaattgtttattacctgtgactggctatggctttgcaacgccactcgtaaaactagtactttgcggttaggggaagtagacaaacccattactccacttcccggaagttcaactcattccaacacgaaataaaagtaactcaacaccccaagcaggctatgtggggggtgatagggtggattctatttcctatcccatcccctaggatctcaattaagttactagcgagttaaatgtctgtagcgatcccgtcagtcctatcgcgcgcatcaagacctggttggttgagcgtgcagtagatctcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 790378 - DNA, 709 bp, Homo sapiens
  misc_feature: 11547.44.62.F07.1.pb.heavy.1.raw 11547
ctatgcgccttgccagcccgctcagacagtatataggaagtagtccttgaccaggcagcccagggccgctgtgctctcggaggtgctcctggagcagggcgccagggggaagaccgatggcccttggtggaggctgaagagacggtcaccactgtcccccggcccaagtactaaaggtgtcatggggggtcaccgtggtcctggctttcaaacagtaatagacgccctgtgtcctcgggtctcaggtttttcatttggagaaacaatttgtcctgcgaattgtccctggaaatggtgaagcggcccttcacggagtctccgtagaaagtgacaccaccagctccgatacttgagacccactccagtcccctccctggagcccggcggacccaggtcatgccataggcactaaggtgaatccagaggccgcacaggagagggtcagggacctcccaggccgaatcaggccccccagactccaacaactgcacttcacacacgacaccctttaaaaaagccacaagaaaaaggcagctcagcccaaactccatggagacttctctctgttcggtcctggtcaccaaatgaagacacctgaaaatcccagggctggggctcctctctcagagctcccctttccctttatgcgactactaaatcgagcaccggtcgtgtatatactgtctgatggcgcgagggaggcgatacg

SEQ ID NO: 790379 - DNA, 617 bp, Homo sapiens
  misc_feature: 11552.44.23.C01.1.pb.heavy.1.raw 11552
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgcggatccagccccaagaatgatcagaactgatgaaactccagagacagtgcagatgagagacagggttcccgaaggcctcaccagtcctgggcccgactcctgcagctgcacctgggacaggacccatctgggagctgccaccagcaggaggaaaaaccacaggtgttcacctgccccaatccctaatcacgtgtactaaatcgagcaccggtcgtgtatatactgtctgatggcgcgagggaggcgatacg

SEQ ID NO: 790380 - DNA, 715 bp, Homo sapiens
  misc_feature: 11556.UNK.UNK.UNK.pb.heavy.1.raw 11556
ctatgcgccttgccagcccgctcagacagtatataggaagtagtccttgaccagggcagcccagggccgctgtgcccccagaggtgctcttggaggagggtggccaggggaagaccgatgggccctttggtggaggctgcggcgacggtgaccagggctccctggccccaggagttgaaaccacccacccactgtggatccagtccccccctcttcgcacagaaataaagggccgtgtcttcgactctcaggctgttcatttccagaaaaagtgtgtttccggaattgtctctgagatggtgaagcggccttcacggacctctccgtagtatgtgtcagttgcactagcgccaattgtcgagacccactcgagccccttccctggagcctggcggacccaggtcatggcatagctcctaaaggggaagccagaggctgcacaggagagtctcagggaccccccaggctgtgccaatcctcccccagactccaacagggccacctcacactggacacctttttaaatagtcacaagaaaaagccacctcagcccaaactccatggtgagttctctctgttcagtcctgatcaccaaatgaaaacacctgaaaatcccagggctgggctcctctctcagagctccccgcgacagacgtctgctaaatcgagcaccggttcgtgtaaatactgtctgatggcgcgaggaggcgatacg

SEQ ID NO: 790381 - DNA, 730 bp, Homo sapiens
  misc_feature: 11561.UNK.UNK.UNK.pb.heavy.1.raw 11561
ctatgcgccttgccagcccgctcagacagtatataggaagtagtccttgaccaggcagcccagggccgctgtgcccccagaggtgctcttggaggagggtgccaggggaagaccgatggcccttggtggaggctgaggagacgggcgaccgtggtcccttggccccaggcgtccataccattggagtaggagcatgtcatatctgtatccacgagccccatctctcgcacagtagtagaacagccgtgtcctcggctctcaggctattcatttccagatatagtgtgttcttcgaattgtctctggagatggtgatcggcccttcacggaatctacataatatttattacttccatcataccatataagtgccacccactccagtcccttgcctgaggcctgcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaaccaggtcgcccaaactccatggtgagtcctctgtgttcggtgctgatcaccgactggaaacacgcgccgacttctgggtgctgggctcctctcccagagctccccaacccaagtctatagcactaaatcgagcagccggtcgtgtatatactgtctgaccggcgcgagggaggcgatacg

SEQ ID NO: 790382 - DNA, 670 bp, Homo sapiens
  misc_feature: 11566.UNK.UNK.UNK.pb.heavy.1.raw 11566
ctatgcgccttgccagcccgcttcagacagtatataggaagtagtccttgaccaggcagccagggccgctgctgcccccagaggtgctcttggaggagggtgcagggggaagaccgatggcccttggtggaggctgaggagacggtgaccagggttccctggccccagtggtcaaagtagttggtgacgaactgccctactctcgcacagtaatacacggccgtgtccgcggcgggtcacagagctcagcttcagggagaaactggttttgacgtgtctactgagtatggtgactcgactcttgagggacgggttgtagtaggtgctccccactataatagatactcccaatccactccagccccttccctggggctggcggatcccagccccagtagtaactactactgctgatggagccaccagagacagtgcagggtgaggggacagggtctccgaaggcttcaccagtcctgggcgccgactcctgcagctgcagctgggacaggaccatctgggagccgccaccagcaggaggaagaaccacaggtgcttcatgttcttgcacaggaggtccatgactctcagaaagccgccccgcggatctacactactaaatcgaggcaccggtcgtgtatatactgtctgatgcgccgagggaggcgatacg

SEQ ID NO: 790383 - DNA, 703 bp, Homo sapiens
  misc_feature: 11578.UNK.UNK.UNK.pb.heavy.1.raw 11578
ttgccagcccgcctcagacagtatataggaagtagtccttgaccaggcagcccagggccgctgtgcccccagaggtgctcttggaggagggtgccagggggaagacgatgggcccttggtggaggcggaggcgacgggtgaccaggttccctggccccagaagtcaaagcgaataataaccactccgagcgccgacttgtctcgcacagtaatagaacggccgtgtcgtcgcctctcaggtgttcatttgaagataaaccgtgttcctggaattgtccctggagatgggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctggaccccccaggctggactaagccctcctccagactccatcagccggcacctcacactggacaccttttaaaagtccaacaaggagaacccagctcagccaaaactccatggtgagtcctctgtgttcagtgctgatcaccgaatgggaaacacctcggaatcccagtgctgggctcctctccccaaacccaacgtgcgagtgctaaatcgagcaccggtcggtgtatatactgtctgtctgatggcgccgagggaggcgaacg

SEQ ID NO: 790384 - DNA, 585 bp, Homo sapiens
  misc_feature: 11581.44.78.H01.1.pb.heavy.1.raw 11581
catgcgccttgccagcccgctcagacagtatataggaagtagtccttgaccaggcagcccagggcgctgtgctctcggaggtgctcctggagcagggcgccagggggaagaccgatggcccttggtggaggctgaggagacggtgaccagggttccctggcccacaagtcaagcaggtgctggtggctctcgcacagaaatacacggccgtgtcctcagatctcaggctgctcagttccatgtagactgtacctggggaggtgcgcctggtcatactaactctgccttggaacttctgggcaaagcccgtgttgccactatagggcttcatccatcccatccactccagcccttgtccagcggcctgtcgcacccattaatatcataattgatgaacgtgtatccagaagccgtgcaggagactgtcactgaggccccaggcttcttcacctcagccccagactgcaccagctgtacctgggagtggaccgtcagtcttctcttcccccaaacccaaactactcacactaaatcgagcaccggtcgtgtatatactgtctgatggcgcgcgagggaggcgatacg

SEQ ID NO: 790385 - DNA, 668 bp, Homo sapiens
  misc_feature: 11597.44.36.D03.1.pb.heavy.1.raw 11597
ctatggcgccttgccagccctcagacagttataggaagtagtccttgaccaggcagccaggccgctgtgctctcggaggtgctcctggagcagggcgccaggggagacgatgggccttggtggaggcctgaggagcggtgaccagggttccctggcccagtggacagttcctgatataaaacacaacacaataatacatgccgtgtcctcggttttcaggttagtcattcgcagatcatggttcttgaagtcatctctgagagggtgaatctggcttcacagacgcgcgtactctgtgataaagcggcaactttgttttactgcggcaagccactcagcccttccctggagcctggcgaccagtcctatagtgtcactgatggtgaatccagaggcgacacaggagagtctcagggaccctccaggctggacaagtctccccggactccaccactgcacttcactctggacacttgtaaaataacaacaaggaaaccagctcagcccgaaactcatggtgagtctctgtgttcagtgctgatcaccaatgaaaacacctgggaattctggggctgggctccgctctcaggctcccaagagagatcgtgacgcagctaatcgagcaccggtcgtgtatatactgtctgatgcgcgagggaggcgatacg

SEQ ID NO: 790386 - DNA, 709 bp, Homo sapiens
  misc_feature: 11602.44.55.E11.1.pb.heavy.1.raw 11602
cgtatcgcctccctcgcgccatcagacagtatatacacgaccggtgctcgatttagcactcgcacgttgggtttgggggggagaggagcccagcactgggattccgaggtgtttccattcggtgatcagcactgaaacacagaggactcaccatggagttttggctgagctggttctccttgttggacttttaaaaaggtgtccagtgtgaggtgcggctgatggagtctggaggaggcttagtccagcctgggggggtccagagactctcctgtgcagcctctgggctcaccgtcagcagccaactacatgagttgggtccgccaggctccagggaaggggcctggagtgggtctcagtcatttatactggtgatttcacatactacgcagactccgtgaagggccgattcaccatctccaggacaattccaggaacacggtttatcttcaaatgaacaacctgagaggcgacgacacggccgtctattactgtgcgagacaagtcggcgctcggagtggttattattcgtttgacttctggggccagggaaacctggtcaccgtcgcctccgcctccaccaagggcccatcggtcttcccctggcaccctcctccaagagcacctctggggacacagcgggccctgggctgccctggtcaaggactacttcctatatactgtctgagcgggctggcaaggcgcatag

SEQ ID NO: 790387 - DNA, 697 bp, Homo sapiens
  misc_feature: 11625.UNK.UNK.UNK.pb.heavy.1.raw 11625
ctatgcgccttgccagcccgctcagacagtatataggaagtagtcctttgaccaggcagcccagggccgctgtgctctcgaggtgctctggagcagggcgccagggaagaccgatgggcccttggtggaggcctgaggagacggtgaccagggttccctggccccagtggacatcctgatataaacacaacacaatatacatgcccgtgtcctcggtttcagtgtagtcattcgcagaatcaatgagttcttgaagtcatctcttgagagggtaatctggctttcacagacgcgcgtactctgtgataaagctggcaacttgtttttactggcggccaagccactccagccccttccctggagcctggcggacccagtccatcatagtggtcactgatggtgaatccagaggcgacacagagagtctcagggaccctccaggctggaccaagtctcccccggactccaccaactgccacttcactctggacaccttgtaaaataacacaaggaaacacccagctcagcccgaactcatggtgagtcctctgtgttcagtgctgatcaccaaatgaaaacacctggaattctgggctggggctcgctctcagagctccccaaaagagatcgtggacgcagctaaaatcgagcaccgggtcgtgtatatactgtctgatggcggcgaggaggcgatacg

SEQ ID NO: 790388 - DNA, 684 bp, Homo sapiens
  misc_feature: 11642.44.36.D03.1.pb.heavy.1.raw 11642
cgtatcgcctcctccgcgccatcagacagtatatacacgaccggtgctcgatttagctgcgtcacgatctctcttgggggagagcggagcccagcccagaattcccaggtgttttcatttggtgatcagcactgaacacagaggactcacatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtgcttggccgcagtaaaaacaaagttgccagctttatcacagagtacgcgcgtctgtgaaagccagattcacctctcaagagatgacttcaagaactcattgattctgcgaatgactaacctgaaaaccgaggacacggcatgtattattgtgttgtgtttatatcaggaactgtccactggggccagggaaccctggtcaccgtctcctcagcctccaccagggccatcgtcttcccctggcgcctgctccaggagcacctccgagagcacagcggccctggctgcctggtcaaggactactcctatatactgttgagcgggctggcaaggcgcatag

SEQ ID NO: 790389 - DNA, 634 bp, Homo sapiens
  misc_feature: 11695.UNK.UNK.UNK.pb.heavy.1.raw 11695
cgtatcgcctccctcgcgccatcagacagtatatacacgaccgtgctcgatttagctcgatatagttgggttgggatgctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgctctggagtttccatcagttcgatcattcttgggctggatcggcagcccccaggagggaatggagtgattggtgacatccattatacgggcgacgtactactctccgtccctcaagagtcgtctcaccatttcgaggacacgtccatgaaccgcttctccctaaactgacctccgtgaccccgcgacacggccgtttatttctgtgcgaggcgagactggtctttcatctatggggccgtggcaccctggtccactgtctcctcagcttccaccaaggcccatcggtcttccctggcgccctgctcaggagcacctctgggggcacagcggccctgggctgcctggtcaaggactacttcctatatactgtctgagcgggctggcaaggcgcatag

SEQ ID NO: 790390 - DNA, 750 bp, Homo sapiens
  misc_feature: 11717.UNK.UNK.UNK.pb.heavy.1.raw 11717
ctatgcgccttgccaggccggctcagaaaacagtatataggaaagtagttccttgaccaggcagcccagggccgctgtgcccccagaggtgctcttggaggagggtgccagggggaagaccgatgggccctttggtggaggcggaggcccgaacggtgaccagggtttccctggccccagaagtcaaaacgaataataaccactccgagccgccgacttgtctcgcacagtaatagacggccgtgtcgtcgcctctcaggttgttcatttgaagataaaaccgtgttcctggaattgtccctggagatggtgaatcggccctttcacggagttctgcggtagtatgtgaaatcaccagtataaaatgactgagaccccactccagccccttccctggaggcctggcggacccaactcatgtagttgctgctgacgcgtgaggcccagaagctgcaacaggagagtctctgggacccccccaggctggactaagcctcctccagactcccatcagccgcaacctcacactggaacaccttttaaaaaagtccaaacaagggaagaaacccagctcagcccaaaaaacttccatggtgagttcctctgtgtttcagtgctgatcaccgaatggaaaacacctcggaaaatcccagtgcctggggcttcctctccccaaaacccaaacgtgcgaagtgctaaatcgagccaccgtcgtgtatatactgtctgatggcgcgaggaggcgttacg

SEQ ID NO: 790391 - DNA, 730 bp, Homo sapiens
  misc_feature: 11735.44.86.H09.1.pb.heavy.1.raw 11735
ctatgcggcttgccagcgccgcctcagacagtatatagtcgtcttgaccaggcagcccagggccgctgtgcccccagaggtgctcttggaggagggtgccagggggaagaccgatgggcccttggtggaggctgaggagacggcgaccgtggtcccttggcccccaggcgtccataccattgagtagagcaatgctcatatctgtatccacgaggccccatctctcgcacagtagtagacagccgtgtcctcggctctcaggctattcatttccagatatagtgtgttcttcgaattgtctctggagatggtgaatcggcccttcacggaatctacatatatttattacttccatcatgccatataagtgccaccactccagtcccttgcctggagcctggcggacccagtgcatgccatgtctgtgaaggtgaatccagacgctacacaggagagtctcagggagcccctccaggctggaccacgcctccccccagactccaccagcttcacctgcactggacacctcttaaagagcaacgaggaaaaacccggtcagccaaactccatggtgagtcctctgtgttcgggggtgctgatcaccgactggaaacaccgccgacttctggtgctgggctcctctcccagagctcgcccaacccaagtctatagcactaaatcgagcaccggtcgtgttatactgtctgatggcggcgagggaggcgatacg

SEQ ID NO: 790392 - DNA, 704 bp, Homo sapiens
  misc_feature: 11758.44.36.D03.1.pb.heavy.1.raw 11758
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctcccaagagagatcgtgacgcagctaaatcgagcaccggtcgtgtatatactgtctgatggcgcgagggaggcgatacg

SEQ ID NO: 790393 - DNA, 564 bp, Homo sapiens
  misc_feature: 11766.UNK.UNK.UNK.pb.heavy.1.raw 11766
ctatgcgccttgccagccccgctcagacagtatataggaagtagtccttgaccaggcagcccagggccgctgtgctctcggaggtgctcctggagcaggcgccagggggaagaccgatgggcccttggtggaggctgaggagacggtgaccagggtcccctggccccagtcatgcgcccggtaataactactaccaccttcccgatctcgcacagtaatacagagccgagtcctcgactctcaggctgaccatttccaagtacacaatgttccgggaattgtctctggagatggtgaatcggcccttcacggagtctgcataatattcagaacttccatcatgtgctataactgccaaccactccggccccttgcctggagcctggcggacccagtgcatgccagaaccactgaaactaaatccagaggcttcacaggagagtctcagggacctcccaggctggaccacgcctcccccagactccaccaggtgcacctgacagtggacacctcttaaaagagcaacgaggaaaacccagctcagcccaaactccattggtgagt

SEQ ID NO: 790394 - DNA, 699 bp, Homo sapiens
  misc_feature: 11794.44.36.D03.1.pb.heavy.1.raw 11794
ctatgcgccttgccagcccgctcagacagtatataggaagtagtccttgaccaggcagccagggccgctgtgctctcggagggctcctggagcagggcgccagggggaagaccgatgggcccttggtggaggctgaggagacggtgaccagggttccctggccccagtggacagttcctgatataaacacaacacaataatacatgcccgtgtcctcggtttttcaggttagtcattcgcagaatcaatgagttcttgaagtcatctcttgagagggtgatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactcatggtgagtcctctgtgttcgtgctgatcaccaaatgaaaacacctggaattctggggctggggctccgctctcagagctccccaagagagatcgtgacgcagctaaatcgagcaccggtcgtgtatatactgtctgatggcgcgagggagcgatacg

SEQ ID NO: 790395 - DNA, 657 bp, Homo sapiens
  misc_feature: 11809.44.12.B01.1.pb.heavy.1.raw 11809
cgtatcgcctccctcgcgccatcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaagggctgagtggattggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactacttgaccactgggccagggaaccctggtcaccgtctctcagcctccaccagggcccatcggtcttcccctggcaccctcctccaagagcacctctgggggcacagcggccctgggctgcctggtcaaggactacttcctatatactgtctgagcgggctggcaaggcgcataag

SEQ ID NO: 790396 - DNA, 694 bp, Homo sapiens
  misc_feature: 11818.UNK.UNK.UNK.pb.heavy.1.raw 11818
cgtatcgcctccctcgcgccatcagacagtatatacacgaccgtgctcgattagcgagacgcgcagggggggagacgagcccagcactggaagtcgccggtgtttccattcggtgatcatcactgaacacagaggactcaccatggactttgggctgagatgggttttctcgttgctcttttaagaggtggccagtgtcaggtgcagctagtgagtctgggggaggagcggcccagcctgggaactccctgagactctcctgtgcagcctctggattcatcttcaggacctatgccatgcactgggtccgccaggctccaggcaaggggctggagtgggtggcaattatatcagaagatggaattgaagaacactacggagactccgagaaggggccgattcaccgtctccagagacaattccaggaacacactgcatctgcaaatgtacaaacctcacaagtgagggacacggctgtctattattgtgcgagagccccctcgagacgcgtccccgcgcttgactactggggcagggaaccctggtcaccgtctcctcagcctcaccaaggggcccatcgtcttcccccctggcgccctgctccaggagcacctccgagagcacagcgcccctgggctgcctggtcaaggactacttcctatatactgtctgagcgggctggcaaggcgcatag

SEQ ID NO: 790397 - DNA, 646 bp, Homo sapiens
  misc_feature: 11851.UNK.UNK.UNK.pb.heavy.1.raw 11851
ctatgcgccttgccagcccgctcagacagtatataggaagtagtccttgaccaggcagcccagggccggctgtgccccagagtgctcctggagcagggcgccaggggaagaccgatggcccttggtggaagctgagagacagtgaccagggtgccacggccccatagattgaaagaccagtctcgcctcgcacagaaataaacggccgtgtccgcggcggtcacggaggtcagtttcagggagaagcgttcatggacgtgtccctcgaaatggtgagacgactcttgagggacggagagtagtacgtcgccccagtatagcatggatgtcaccaatcactccattcccctccctggggggctgccggatccagcccaagaatgatcagaactgatgaaaactccagagacagtgcagatgagagacagggttcccgaaggcctcaccagtcctgggcccgactcctgcagctgcacctggacaggacccatctgggagctgccaccagcaggagaaaaaccacaggtgcttcatgttcttgcacaggaggtccttgactctcagaaagcatccccaaacccaagtctatagcactaatcgagcaccgtcgtgtatatactgtctgatggcgcgaggaggcgatacg

SEQ ID NO: 790398 - DNA, 673 bp, Homo sapiens
  misc_feature: 11852.44.6.A06.1.pb.heavy.1.raw 11852
ctatgcgccttgccagcccgctcagacagtatataggaagtagtccttgaccaggcagtccagggccgctgtgcccccagaggtgctcctggagcagggcgccagggggaagaccgatgggcccttggtggaagctgaggtgacaatgaccagggttccctgcccccagatctcaaaggctccatgcgagctggggtacggacctctcgcacagtagtagacggccgtgtcgtcggatttcaaagaactcattgtcatggagactgtgtctgtggacttgtcgcggtaatcgtaattctgcccggaagtctcgtgcgtaggtgagtgagccaaaaagagggatgattccacccatccactcaagcccttgtccaggggcctggcgcacccagttgatggtataagtagtggaactggtagtacttccagaggccgtgcaggaaagggtcaccgaggaccaaggttgcggcattctagtcccagactgcaccagttgcaccagggactggacacctgttgctgctgccaccacaaagaggaacctccaggtccagtccatggtgatgagctgtgctcccaggggcttctttagaggaggaatgtggttgtcagtagatctaaatcgagcaccggtcgtgtatatactgtctgatggcgcgagggaggcgatacg

SEQ ID NO: 790399 - DNA, 708 bp, Homo sapiens
  misc_feature: 11856.44.27.C05.1.pb.heavy.1.raw 11856
ctatgcgccttgccagcccgctcagacagtatataggaagttagtccttgaccaggcaggcccagggccgctgtgctctcggaggtgctcctggagcagggcgccagggggaagaccgatggcccttggtggaggccgaggagacggtgaccagggttccctggccccagcggtcgaatgaaccgattttggaaacagatagtctcgcacaaaaaatacacggccgtgtcctgaggtctcaggctgttcatttgaagagacactgtgttctcggaattgtctctggagatggtgaatcggcctcaacggaatcaccgtagacttgatttcctccatgaaatgacacacctgccacaccactccagccctcgcctggagcctggcggacccactgcatattccaattatcgaaggtgaatccagaggctgcacaggagagtctcagggacccccctactgggccacgcctccccagactccacgaattgcacctgacacatgacacctcttaagagggcaacgaggaaaacccagctcagcccaaactccatggtgagtcctctgtgttcagtgatgatcaccgagtggaaacaccggcgacttcccagtgctgggctcgtcttccaggccccaaaccctttcgatcgcgtctaaatcgagcaccggtcgtgtatatactgtctgatggcgcgggagggaggcgatacg

SEQ ID NO: 790400 - DNA, 687 bp, Homo sapiens
  misc_feature: 11867.44.67.G01.1.pb.heavy.1.raw 11867
cgtatcgcctcctcgcgccatcagacagtatatacacgaccggtgctcgatttagagtatacatattggtttgggggggagaggagccagcactgggattccgaggtgtttccattcggtgatcagcactgaacacagaggactcaccatggagttttggctgagctgggttctccttgttggacttttaaaaggtgtccagtgtgaggtgcggctgatggagtctgaggaggcttagtccagcctgggggtccagagactctcctgtgcagcctctggctcaccgtcagcagcaactacatgagttgggtccgccaggctccagggaagggctggagtgggtctcagtcatttatactggtgatttcacatactacgcagactcgtgaaggccgattcaccatctccaggacaattccaggaacacggtttatcttcaaatgaacaacctgagaggcgacgacacggccgtctattactgtgcgagacaagtcggcgctcggagtggttattattcgtttgacttctggggccagggaacctggtcaccgtcgcctccgcctccaccaagggcccatcgtctccccctggcaccctcctccaagagcactctggggcacagcggccctgggctgcctggtcaagactacttcctatatactgtctgagcgggctggcaaggcgcat

SEQ ID NO: 790401 - DNA, 704 bp, Homo sapiens
  misc_feature: 11936.44.74.G08.1.pb.heavy.1.raw 11936
ctatgcgccttgccagcccgctcagacagtatataggaagtagtccttgaccaggcagccaggcgccgctgtggcccccagaggtgctcctggagcagggcgccagggggaagaccgatgggcccttgtggaagctgaggtgacaatgaccagggttccctgccccccagatctcaaaggctccatggcgagctgggtacggacctctcgcacagtagtagacggccgtgtcgtcggatttcaaagaactcattgtcatggagactgtgtctgggacttggtccgccggtaatcgtaattctgcccggagagtctcgtgcgtaggcgtgagtgagccaaaaagaggggatgattccacccatccactcaagcccttctgtcaggggcctgcgcacccagttgatggtataagtagtggaactggtagtacttccagagcccgtggcaggaaagggtcaccgaggacaggttgcggcattctagtcccagactgcaccagttgcaccagggactggacacctgttgctgctgcccaccacaaaggaggaacctccaggtccagtcatggtgatgagctgtgctcccaggggcttcttagaggaggaatgtggtttgttatgtgatgctcccccctgatagagctactaaatcgagcaccggtcgtgtatatactgtctgatggcgcggcgaggggaggcgatacg

SEQ ID NO: 790402 - DNA, 721 bp, Homo sapiens
  misc_feature: 11947.44.56.F01.1.pb.heavy.1.raw 11947
ctatgcgccttgccagcccgctcagacagtatataggaaagtagtccttgaccaggcagcccagggccgctgtgcccccagaggtgctcctgagcagggcgccagggggaagaccgattgggcccttggtggaagctgaagagacggtgaccatttgtcccctggccccaaatatcaaatgcatcgacgttcccaggatcgcctggcgcagtaatagacgcctgtgtcgtcgggtctcaggttgctcatttgtaaatggccaacactgtttggagtcatcccttgagacggtgaatcttcccttcacagacgcggcgtactctttacttccaccataaacgtttcattctgacggaaagtgatccactcaagccccttccctggagcctgacggaccaggccaagtgataatcactaagactgaatcctgagacttacacaggagagtctcagagaccgccctggctgtgccaagcccccccccgactccgccagtcgcccctcgcactggacaccttctaaaaaaactacaaggaaaatcaagattagcccaaactccatggttggtggtctgtgctcagtgctgatcaccaagtggaaaactcctgggaatctcacggctggggctcctctcccagagctccccttgtgtgttcagacgtctgctaaatcgagcaccggtcgtgtatatactgtctgatggcgcgagggaggcgatacg

SEQ ID NO: 790403 - DNA, 709 bp, Homo sapiens
  misc_feature: 11959.44.27.C05.1.pb.heavy.1.raw 11959
atcgcctccctcgcgccatcagacagtatatacacgaccggtgctcgatttagacgcgatcgaagggtttggggctgggagacgagcccagcactggaagtcgccggtgtttccactcggtgatcatcactgaaacacagaggactcaccatggagtttgggctgagctgggtttttcctcgttgccctcttaagaggtgtcatgtgtcaggtgcaattcgtggagtctgggggaggcgtggccccagtaggggggtccctgagactctcctgtgcagccctctggattcaccttcgataattggaatatgcagtgggtccgccaggctccaggcgaggggctggagtggggtggcaggtgtgtcatttcatggaggaaatcaagtctacgggtgattccgttgagggccgattcaccatctccagagacaattccgagaacacagtgtctctcttcaaatgaacagcctgagacctcaggacacggccgtgtattttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctggactgcctggtcaaggactacttcctatatactgtctgagcgggctggcaaggcgcatag

SEQ ID NO: 790404 - DNA, 706 bp, Homo sapiens
  misc_feature: 12040.44.36.D03.1.pb.heavy.1.raw 12040
ctatgcgccttgccagcccgctcagacagtatataggaagtagtccttgaccaggcagccagggccgctgtgctctcggaggtgctctggagcagggcgccagggggaagaccgatgggcccttggtggaggctgaggagacggtgaccagggttccccggccccagtagtcaaaaccagccactgaccaagtggcccgatctctcgaacagaagtagacagccgtgtcctcgtctctcaggctgttcatttccagatacagtgagttcttggcattgtccctggaattggtgaatcggccttcacagagtctgcgtagtaggtggtatctccagcaatattaacatatgaaacccactccagccccttccctggagcctggcggacccagttcatggcatagtcactgaagatgaatccagaggctgcacaggagagtctcagggacccccccgctgtaccaagcctccccagactccaccagccgcacctcacagtggacaccttctaaaatagcaacaaggaaaacccagcgcagccccaactccatggtgagtcctctgtgttcattgctgatcaccaagtggaaatgccttggaatcagggctaaggcacctctctgagagctcccaagagagatcgtgacgcagctaaatcgagcaccggtcgtgtatatactgtctgatggcgcgagggaggcgatacg

SEQ ID NO: 790405 - DNA, 658 bp, Homo sapiens
  misc_feature: 12050.44.12.B01.1.pb.heavy.1.raw 12050
ctatgcgccttgccagcccgctcagacagtatataggaagtagtccttgaccaggcagcccagggccgctgtgcccccagaggtgctcttggaggagggtgccaggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctcccactataatagatactccaatccactccagcccttccctggggctggcggatccagccccagtagtaactactactgctgatggagccaccagagacagtgcaggtgagggacaggtctccgaaggcttcaccagtcctgggcccgactcctgcagctgcagctggacaggacccatctgggagccgccaccagcaggaggaagaaccacaggtggcttcatgttcttgcacaggaggtccatgactctcagaagccccgcggaatctacactactaaatcgagcaccggtcgtgtatatactgtctgatggcgcgagggaggcgatacg

SEQ ID NO: 790406 - DNA, 708 bp, Homo sapiens
  misc_feature: 12060.44.55.E11.1.pb.heavy.1.raw 12060
ctatgcgccttgccagccccgctcagacagtatataggaagtagtccttgaccaggcagcccagggccgctgtgcccccagaggtgctcttgggggagggtgccagggggaagaccgatgggcccttggtggaggcggaggcgacggtgaccagggttccctggcccccagaagtcaaacgaataataaccactccgagcgccgacttgtctcgcacagtaatagacggccgtgtcgtcgccctctcaggttgttcatttgaagataaaccgtgttcctggaattgtccctggagatggtgaatcggcccttcacggagtctgcgtagtatgtgaaatcaccagtataaatgactgagacccactccagccccttcctggagcctggcggacccaactcatgtagttgctgctgacggtgagcccagaggctgcacaggagagtctctgggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgcctgggctcctctcccccccaaacccaacgtgcgagtgctaaatcgagcaccggtcgtgtatatactgtctgatggcgcgagggaggcgatacg

SEQ ID NO: 790407 - DNA, 649 bp, Homo sapiens
  misc_feature: 12064.44.86.H09.1.pb.heavy.1.raw 12064
ctatgcgccttgccagcccgctcagacagtatataggaagtagtccttgaccaggccagcccagggccgctgtgcccccagaggtgctcctggagcaggcgccaggggaagaccgatggcctgtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactcattcccctccctgggggctgccggatccagccccaagaatgatcagaactgatggaaactccagagacagtgcagatgagagacagggttcccgaaggcttcaccagtcctgggcccgactcctgcagctgcacctgggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 790408 - DNA, 703 bp, Homo sapiens
  misc_feature: 12066.44.55.E11.1.pb.heavy.1.raw 12066
cgtatcgcctcctcgcgccatcagacagtatatacacgaccggtgctcgattttagcactcgcacgttgggtttggggagaggagcccagcactgggattccgaggtgtttccatttccggtgatcagcactgaacacagaggactcaccatggagttttggctgagctgggttctccttgttgacttttaaaggtgtccagtgtgaggtgcggctgatggagtctggaggagggcttagtccagcctgggggtcccagagactctcctgtgcagcctctggctcaccgtcagcagcaactacatgagttggggtccgccaggctccagggaaggggctggtgggggccgtctcagtcatttatactggtgatttcacaatactacgcagactccgtgaagggccgattcaccatctccagggacaattccaggaacacgttttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttcccctggcaccctcctccaagagcacctctggggcacagcggcctgggctgcctggtcaaggactacttcctatatactgtctgagcggctggcaaggcgcatag

SEQ ID NO: 790409 - DNA, 705 bp, Homo sapiens
  misc_feature: 12073.44.36.D03.1.pb.heavy.1.raw 12073
cgtatcgcctccctcgcgccatcagacagtatatacacgaccggtgctcgatttagctgcgtcacgatctctcttggggagagcggagccccagccccagaattcccaggtgttttcatttggtgatcagcactgaacacagaggactcaccatggagtttcgggctgagctgggttttccttgttgtatttttaaaggtgtccagagtgaagtgcagtttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaagttgccagctttatcacagagtacgccgcgtctgtgaaagccagattcaccctctcaaggagatgacttcaagaactcatttgattctgcgaatgactaacctgaaaaccgaggacacgggcatggtattattgtgttgtgtttatatcaggaactgtccactggggccagggaaccctgtcaccgtctcctcagccccgctgggccccaacggccatcgtctcccccctggcgccctgctccaggagcacctccgagagcacagcggccctgggctgcctggtcaaggactacttcctatatactgtctgaagcgggctggcaaggcgcatag

SEQ ID NO: 790410 - DNA, 708 bp, Homo sapiens
  misc_feature: 12076.44.36.D03.1.pb.heavy.1.raw 12076
cgtatcgcctccctcgcgccatcagacagtatatacacgaccggtgctcgattagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccgactatatggactgggtccgccaggctccagggaaggggctggagtggcttggccgcagtaaaaacaaagttgccagctttatcacagagtacgccgcgtctgtgaaagccagattcaccctcttcaagagatgacttcaagaactcattgattctgcgaatgactaacctgaaaaccgaggacacgggcatgtattattgtgttgtgtttatatcaggaactgtccactggggccagggaaccctggtcaccggtctcctcagcctccaccaagggcccatcggtcttccccctggcgccctgctccaggagcacctccgagagcacagcggccctgggctgcctggtcaaggactacttcctatatactgtctgagcgggctggcaaggcgccatag

SEQ ID NO: 790411 - DNA, 590 bp, Homo sapiens
  misc_feature: 12080.44.78.H01.1.pb.heavy.1.raw 12080
cgtatcgcctccctcgcgccatcagacagtatatacacgaccggtgctcgatttagtgtgagtagtttggtttggggggaagaggaagactgacggtcccactcccaggtacagctggtgcagtctgggctgaggtgaagaagcctggggcctcagtggacagtctcctgcacggcttctgggatacacgtcattcaattatgatattaactgggttgcgacaggccgctggacaagggctggagtggatgggatggatgaagccctatagtggcaacacgggctttgcccagaagttccaaggcagagttagtatgaccaggagcacctcccaggtacagtctacatggaactgagcagcctgagatctgaggacacggccgtgtatttctgtgcgagagcaccagcacctggcttgacttgtggggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 790412 - DNA, 592 bp, Homo sapiens
  misc_feature: 12090.UNK.UNK.UNK.pb.heavy.1.raw 12090
ccgacacgcttgctaggacttggagctaggacgacatattgcctttagacagtcgaagggtgacgcttagctaccactgaacgttaggcgccagatgcgtctgggatgacctaactcgcagcttatcgatgatctactgcacgctcaaaccaaccaggtctttatgcgcgcgataggactgacgggatcgctacagacatttaactcgctagtactaattgagatcctaggggatgggataggaaatagaatcacccctatcacccccccacatagcctgcttgggtgttggtttactttatttcgtgttggatgagttgaacttccgggaagtggagtaatgggttttgtctcatttcccctaaaccgcaagtactagtttttacgagtggcgttgcaagcctatagccagtcaaggtaataaacaatcaagtggcgtaaagattggccgcttgctgtggcattgcaagctgggtttcagcattgtgcatgctagacgacaatagaatctgcggacccctagtggccaagatggccgctagcgggttccgcagctttgacctggaccaggtgcatagcctgcccagccttc

SEQ ID NO: 790413 - DNA, 693 bp, Homo sapiens
  misc_feature: 12095.44.36.D03.1.pb.heavy.1.raw 12095
ctatgcgccttgccagcccgctcagacagtatataggaagtagtccttgaccaggcagcccagggccgctgtgctctcggagggtgctcctggagcaggcgccagggggaagacgatgggccttggtgaggctgaggagacggtgaccaagggttccccggcccccagtagtcaaaaccagcactgaccaagtggcccgatctctcgaacagagtagacagccgtgtcctcgtctctcaggtgttcatttccagatcagtgattcttggcattgccctggaattggtgaatcggccttcacagagtctgcgtagtaggtggtatctcagcatattaacatatgaaacccactccagcccttcctggagcctggcggacccagttcatggcatagtcactgaagatgaatccagaggctgcacaggagagttcagggaccccccccgctgtaccaagcctccccagactccaccagccgcacctcacagtggacaccttctaaatagcaacaaggaaaacccagcgcagcccaactccatggtgagtcctctgtgttcagtgctgatcaccaatggaaatgccttggatccagggctaaggcacctctctgagagctcccaagagagatcgtgacgcagctaaatcgagcaccggtcgtgtatatacgtctgatggcgcgaggagggcgatacg

SEQ ID NO: 790414 - DNA, 704 bp, Homo sapiens
  misc_feature: 12099.44.55.E11.1.pb.heavy.1.raw 12099
ctatgcgccttgccagcccgctcagacagtatataggaagtagtccttgaccaggcagcccagggccgctgtgcccccagaggtgctcttggaggagggtgccagggggaagaccgatggcccttggtggaggcggaggcgacggtgaccagggttccctggccccagaagtcaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgagggaggcgatacg

SEQ ID NO: 790415 - DNA, 724 bp, Homo sapiens
  misc_feature: 12105.UNK.UNK.UNK.pb.heavy.1.raw 12105
cgtatgcgcccttgccagccccgctcagacagtatataggatagtcggagtccttgacaggcagccccagggccgctgtgctctcggaggtgctcctggagcagggcgccagggggaagaccgatgggcccttggtggaggctgaggaggagcgtgaccagggttccctggccccagtggacagttcctgatataaacacaaacacaataatacatgccgtgtcctcggttttcaggttagttcattcgcagaatcaatgagttcttggaagttcaatctcttgagagggtgaatctggctttcacagacgcggcgtactctgtgataaagctggcaactttgtttttactgcggccaggcactccagcccctttccctggagcctggcgggacccgcaggtccatatagtggtcactgatggtgaatccagaggcgacacaggagagtctcagggaccctccaggcgtggaccaagtctccccggactccaccaactgcacttcactctggacaccttgtaagaataacaacaaaggaaaaccagctcagccccgaactccatggtgagttcctctgtgttcagtgctgatcaccaaatgaaaacacctgggaattctgggctggggctccgctctcagagctccccaagagagatcgtgacgcagctaaatcgagcacgcgtcgtgatagtatagactgatggcgcgagggaggcgattacg

SEQ ID NO: 790416 - DNA, 696 bp, Homo sapiens
  misc_feature: 12124.44.36.D03.1.pb.heavy.1.raw 12124
ctatgcgccttgccagcccgctcagacagtatataggaagtagtccttgaccaggcagcccagggccgctgtgctctcggaggtgctcctgagcagggcgccagggggaagaccgatgggcccttggtggaggctgaggagacggtgaccagggttccctgccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcccccaagagagatcgtgacgcagctaaatcgagcaccggtcgtgtatatactgtctgatggcgcgagggaggcgatacg

SEQ ID NO: 790417 - DNA, 655 bp, Homo sapiens
  misc_feature: 12129.44.57.F02.1.pb.heavy.1.raw 12129
cgtatcgcctccctcgcgccatcagacagtatataccacgaccggtgctcgattagctcgatatagttgggtttgggatgctttctgagagtcaaggacctcctgtgcaagaacatgaagcacctgtggtttttctcctgctggtggcagctcccagatgggtcctgtccaggtgcagctgcaggagtcgggcccaggactggtgaggccttcgggaaccctgtctctcatctgcactgtctctggagtttccatcagtttctgatcattcttgggctggatccggcaaagcccccaggggagggggaatggagtggattggtgacatccattatactgggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctattggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcggctggcaaggcgcatag

SEQ ID NO: 790418 - DNA, 548 bp, Homo sapiens
  misc_feature: 12133.UNK.UNK.UNK.pb.heavy.1.raw 12133
cgtatcgcctccctcgcgccatcagacagtatatacacgaccggttctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccaggggcagagtcaccatgaccaggaacacctccataaacacagcctacatggagctgagcagcctgagatctgaggacacggccgtgtattactgtgcgagatcccgaaagtatagcagctcgtcggggaggtggttcgacccctggggccagggaaccctgtcaccgtctcctcagcttccaccaagggcccatcgcggtcttccccctggcggcctgctccaggagcacctctgggggcacagcggccctgggctgcctggtcaaggactacttcctatatactgtctgagcggctggcaaggcgcc

SEQ ID NO: 790419 - DNA, 676 bp, Homo sapiens
  misc_feature: 12188.44.71.G05.1.pb.heavy.1.raw 12188
ctatgcgcctgccagccgctcagacagtatataggaagtagtccttgaccaggcagccagggccgctgtgccccagaggtgctcctggagcagggcgccagggggaagaccgatggcccttggtggaagctgaagagacggtgaccattgtccctggcccaaatatcaaatgcatcgacgtcccaggatcgcctggcgcagtaatagacgcctgtgtcgtcggtctcaggttgctcatttgtaatggccaacactgttggagtcatccttgagacggtgaatcttcctcacagacgcggcgtactctttacttccaccataacgtttcattctgacgaaagtgatccactcaagcccttccctggagcctgacggacccaggccaagtgataatcactaagactgaatcctgagactacacaggagagtctcagagaccgcctggctgtgccaagccccccccgactccgccagtcgccctcgcactggacaccttctaaaaaactacaaggaaaatcaagattagcccaaactccatggttggtggtctgtgctcagtgctgatcaccaagtggaaactcctgggaatctcacgctggggctcctctctcttgcgacgacactaatcgagcaccggtcgtgatagtatagactgatggcgcgaggaggcgatacg

SEQ ID NO: 790420 - DNA, 671 bp, Homo sapiens
  misc_feature: 12196.44.73.G07.1.pb.heavy.1.raw 12196
cgtatcgcctccctcgcgccatcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtctgggggaggcgtgtccagcctggaggtccctgagactctctgtgaagctctggattagtttcagtagttctggcatgcactgggtcgccaggctccaggcaaggggcggagtggttggcagttatagcatatgatggaacttctagatattatgcagactccgtgaaggccgattcaccatctccagagacaattccggaacactctgtacctggaaatgatcagcctgagaggcgaggactcggctctgtattactgtgcgagatcgggaagtggcagcagctattatcgggcgttcactgggccagggacactgtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 790421 - DNA, 694 bp, Homo sapiens
  misc_feature: 12200.44.74.G08.1.pb.heavy.1.raw 12200
ctatgcgccttgccagcccgctcagacagtatataggaagtagtccttgaccaggcagcccagggccgctgtgccccccagaggtgctctggagcagggcgccagggggaagaccgatgggcccttggtggaagctgaggtgacaatgaccagggttccctgcccccagatctcaaaggctccatgcgagctggggtacggacctctcgcacagtaagtagacggccgtgtcgtcggatttcaaagaactcattgtcatggagactgtgtctgtggacttgtccgcggtaatcgtaattctgccccggaagtctcgtgcgtaggtgagtgagccaaaaagagggatgattccacccatccactcaagcccttgtccaggggcctggcgcacccagttgatggtataagtagtggaactggtagtacttccagagccgtgcaggaaagggtcaccgaggaccaaggtgcggcattctagtcccagactgcaccagttgcaccagggactgggacacctgtttgctggtgccaccacaaagaggaacctccaggtccagtccatggtgatgagctgtgctccaggggcttctttagaggaggaatgtggttgttatgtgatgctccccctgatagagctactaaatcgagcaccggtcgtgtatatactgtctgatggcgcgagggaggcgatacg

SEQ ID NO: 790422 - DNA, 661 bp, Homo sapiens
  misc_feature: 12222.UNK.UNK.UNK.pb.heavy.1.raw 12222
ctatgcgcctgcacccgctcagacagtatataaggaagtagtccttgaccaggcagcccaggccgctgtgctcccagaggtgctcttggaggagggtgccagggggaagaccgatgggccctggggggctgaggagacggtgaccaggttcctggcccagtgtcaaagtagttggtgacgaactgccctactctcgcacagtaatacacggcccgtgtccgcggcggtcacatgagctcagcttcagggagaactggttcttgggacgtgtctactgatatggtgactcgactcttgaggggaagggttgtcagtaggtgctcgccactataatagatactcccaatcactccagcccttccctggctggcggatccagcccagtagtaactactactggcctgatggagccccaagagacagtgcaggtgagggacagggtctccgaaggctgtcaaccagtcctgggcccgactcctgcagcctgcaagctggacaggacccatcctgggagccgccaccagcaggaggaagaaccacaggtgcttcatgttcttgcacaggaggtccatgactctcagaaagagccccgcggaatctaccacactaaatcgagcaccgtcgtgtatatactgtctgatggcgcgagggaggcgatacg

SEQ ID NO: 790423 - DNA, 603 bp, Homo sapiens
  misc_feature: 12228.UNK.UNK.UNK.pb.heavy.1.raw 12228
gaaggctggcaggctatgcaccctggtccaggtcaaaagctgcggaacccgctagcggccatctggcactagggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaataaaagtaaactcaacacccaagcaggctatgtggggggggtgataggggtggattctatttcctatccatcccctaggatctcaattaagttactagcgagttaaatgtctgtagcgatcccgtcagtcctatcgcggcgcatcaagacctggttggttgagcgtgcagtagatcatcgataagctgcgagttaggttcatcccagaccgcatctggcgcctaaacgttcagtggtagctaaggcgtcaccttcgactgtctaaaggcaatatgtcgtccttagctccaagtccctagcaagcgtgtcgg

SEQ ID NO: 790424 - DNA, 606 bp, Homo sapiens
  misc_feature: 12238.44.36.D03.1.pb.heavy.1.raw 12238
cgtatcgcctccctcgcgccatcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctggttctctctcaacgatattagaatgggtgtgagctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatgcgggaaagaaacagctggtttctgtattataagtcttaccatctggacgtctgggcaaagggaccacggtcaccgtctcctcagctttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 790425 - DNA, 714 bp, Homo sapiens
  misc_feature: 12252.44.27.C05.1.pb.heavy.1.raw 12252
ctatgcgccttgccagcccgctcagacagtatataggaagtagtccttgaccaggcagcccagggccgctgtgctctcggaggtgctcctggagcaggcgccagggggaagaccgatgggcccttggtggaggccggaggagacggtgaccagggttccctggccccaggcgtcgaatgaaccgattttggaaacagatagtcttcgcacaaaaatacacggccgtgtcctgaggtctcaggctgttcatttgaagagacacctgtgttttttcggaattgtctctggagatggtgaatcggccctcaacggaatcaccgtagacttgatttcctccatgaaatgacacacctgccacccactccaggcccctcgcctggagcctggcggacccactgcatattccaattatcgaaggtgaatccagaggctgcacaggagagtctcagggacccccctactggggccacgcctcccccagactccacgaattgcacctgacacatggacacctcttaaaggagggcaacgaggaaaacccagctcagcccaaactccatggtgagtcctctgtgttcagtgatgatcaccgagtggaaacaccggcgacttcagtgctgggctcgtctcccaggcccccaaacccttcgatcgcgtctaaatcgagcaccggtcgtgtatatactgtctgatggcgcgagggaggcgaatacg

SEQ ID NO: 790426 - DNA, 730 bp, Homo sapiens
  misc_feature: 12258.44.33.C11.1.pb.heavy.1.raw 12258
cgtatcgcctccctcgcgccatcagacagtatatacacgaccggtgctcgatttagagtgagctcgttgggtttggggagctctgggagaggagcccagcaccagaagtcggcggtgttttccagtcggtgatcagcaccgaacacagaggactcaccatggagtttgggctgacctgggtttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaaggactggagtggtggcacttatatggtatgatggaagtaataaatattatgtagattccgtgaagggccgattcaccatctccagagacaattcgaagaacacactatatctggaaatgaatagcctgagagccgaggacacggctgttctactactgtgcgagagatggggctcgtggatacagatatgacatgctctactccaatggtatggacgcctgggccaagggaccaacggtcgccgtctcctcagcctccaccaaggggcccatcggtcttccccctggcaccctcctccaagagcacctctgggggcacagcgggctgggctgcctggtcaaggactacttcctatatacgtctgagcgggctggcaaggcgcatag

SEQ ID NO: 790427 - DNA, 607 bp, Homo sapiens
  misc_feature: 12296.UNK.UNK.UNK.pb.heavy.1.raw 12296
cccgacacgcttgctagggacttggagctaaggacgacatattgcctttagacagtcgaaggtgacgccttagctaccactgaacgtttaggcgccagatgcggtctgggatgaacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttgggtgttgagtttacttttatttcgtgttggaatgagttgaacttccgggaagtggagtaatgggtttgtctacttccctaaccgcaaagtactagtttacgagtggcgttgcaagccatagccagtcacaggtaataaacaattcaacgtggcgtaaagattggccgcttgctgtgggcattgcaagctgggttttgcagcattgtgcatgctagacgacaatatgaatctgcgggacccctagtggccaagatggccgctagcgggttccgcagcttttgacctggaccagggtgcatagcctgcccagccttc

SEQ ID NO: 790428 - DNA, 608 bp, Homo sapiens
  misc_feature: 12298.UNK.UNK.UNK.pb.heavy.1.raw 12298
gaaggctggggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaaaccattactccacttcccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctgggcctaaacgttcagtggtagctaaggcgtcaccttcgactgtctaaaggcaatatgtcgtccttagctccaagtccctagcaagcgtgtcggg

SEQ ID NO: 790429 - DNA, 649 bp, Homo sapiens
  misc_feature: 12336.44.71.G05.1.pb.heavy.1.raw 12336
cgtatcgcctccctcgcgccatcagacagtatatacacgaccggtgctcgatttagtgtcgtcgcaagagagaggggccagccctggggactgaacagagagaactcaccatggagtttgggctgagctggcttttcttgtggctgtttaaaaggtgtccagtgtgaagtgcagctgttgagtcggggggagctgtacagccggggggtccctgacactctcctgtgcagcctctggattcgcctttaatcctatgccatgatctgggtcgtcaggccccagggaagggctggagtgggtctcatccattactggtggtagtgccacaaatgtcgcagactccgtgaagggccgcttcatcgtctcagggacaattccaagaatacggtgttctgcagatgaagagcctgcgtggacgacacgcctttattactgtgccagagggtcgcagaattacaacaatacaagtatactactacatggacgtctgggcaaagggaccccggtcaccgtctctcagcctccaccagggcccatcggtcttccccctggcacctcctccagagcacctctggggcacagcggccctgggctgcctggtcaaggactacttcctatatactgtctgagcggctggcaaggcgcatag

SEQ ID NO: 790430 - DNA, 540 bp, Homo sapiens
  misc_feature: 12351.UNK.UNK.UNK.pb.heavy.1.raw 12351
cgtatcgcctccctcgcgccatcagacagtatatacacgacgggtgctcgatttagactagcagtaaggggctgaggtgagaagcctgggcctcagtgaaggtctcctgccaaggcttctgatacaccttcaccattatgatatcaactggtgcgacaggccactgacaagggcttgagtggatggatggatgaaccctaacagtggtaacacaggctatgcacagaagttccagggcagagtcaccatgaccaggaacacctccataaacacagcctacatggagctgagcagcctgagatctgagacacggccgtgtattactgtgcgagatcccgaaagtatagcagctcgtcggggaggtggttcgacccctggggccagggaaccctggtcaccgtctctcagcttccaccaaggggccatcggtctttccccctggcgccctgctccaggagcacctctgggggcacagcggccctgggctgcctggtcaggactacttcctatatactgtctgaggggctggcaggcgcatag

SEQ ID NO: 790431 - DNA, 665 bp, Homo sapiens
  misc_feature: 12363.44.12.B01.1.pb.heavy.1.raw 12363
cgtatcgcctccctcgcgccatcagacagtatatacacgaccggtgctcgatttagtagtgtagattccgcgggggctttctgagagtcattgacctcctgtgcaagaacatgaagccacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaagggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactgggccagggaaccctggtcaccgtgtctcctcagcctccaccaagggcccatcggtcttcccctggcacctcctccaagagcacctctgggggcacagcggccctgggctgcctggtcaaggactacttcctatatactgtcctgagcgggctggcaaggcgcatag

SEQ ID NO: 790432 - DNA, 702 bp, Homo sapiens
  misc_feature: 12385.44.27.C05.1.pb.heavy.1.raw 12385
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagccctcgcctggagcctggcggacccactgcatattccaattatcgaaggtgaatccagaggctgcacaggagagtctcagggacccccctactgggccacgcctcccccagactccacgaattgcacctgacacatgacacctcttaagagggcaacgaggaaacccagctcagcccaaactccatggtgagtcctctgtgttcagtgatgatcaccgagtggaaacaccggcgacttccagtgctgggctcgtctccaggccccaaaacccttcgatcgcgtctaaatcgagcaccggtcgtgtatatactgtctgatggcgcgagggaggcgatacg

SEQ ID NO: 790433 - DNA, 621 bp, Homo sapiens
  misc_feature: 12404.UNK.UNK.UNK.pb.heavy.1.raw 12404
cgtatcgcctccctcgcgccatcagacagtatatacacgaccgggtgctcgatttagtatctgatagctgggttttccttgttgctattttaaaaggtgtccagtgtgaggtgcagctggtggagtccggggaggcttagttcagcctggggggtccctgagactctcctgtgcagcctctggatcaccttcagtagctactggatgcactggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagcccgaggacacggctgtgtattactgtgcaagagccggtgcgggagttcgggagttgcatactactactacggtatggacgtctgggggccaaggaccacggtcaccgtctcctcagcttccaccaagggcccatcggtcttcccctggcggccctgctccaggagcccttctgggggcacagcggcccctgggctgcctggtcaaggactacttcctatatatactgtctgagcgggcctggcaaggcgcatag

SEQ ID NO: 790434 - DNA, 455 bp, Homo sapiens
  misc_feature: 12435.UNK.UNK.UNK.pb.heavy.1.raw 12435
ctatgcgcctgccagcccgctcagacagtatataggaagtagtccttgaccaggcagcccagggccgctgtgcccccagaggtgctcctggagcaggccgccagggggaagaccgatggcccttggtggagctgagagacggtgacgtggtcccttggccccagacgtccataccgtagtagtagtatgcaactccccgaactcccgcaccggctcttgcacagtaatacacagcgtgtcctcggctctcagactgttcattgcagtacgatagcgtgttctggcgttgtctctgagagatggtgaatcggcctgttcacggagtccgcgtagcttgtgctgactcccatcactattaatacgtgagacgcccacaccagcccctttcccttagagcgtagctaaatcgagcaccgtcgtgtatatactgtctgatggcgcgaggaggcgatacg

SEQ ID NO: 790435 - DNA, 726 bp, Homo sapiens
  misc_feature: 12438.44.86.H09.1.pb.heavy.1.raw 12438
ctatgcgccttgccagcccgctcagacagtatataggaagtagtccttgaccaggcagcccaggccgctgtgcccccagaggtgctcttggaggagggtgccagggggaagaccgatgggcccttggtggaggctgaggagacggcgaccgtgtcccttggccccaggcgtccataccattggagtagagcatgtcatatctgtatccacgagccatctctcgcacagtagtagacagccgtgtcctcggctctcaggctattcattttccagatatagtgtgtttcttcgaattgtctctgagatggtgaatcgcccttcacggaatctacaataatatttattacttccatcataccatataagtgccacccactccagtccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagttcctctgtgttcggtgctgatcaccgactggaaacaccgccgacttctggtgctgggctcctctcccagagctccccaacccaagtctatagcactaaatcgagcaccggtcgtgtatatactgtctgatggcgcgagggaggcgatacg

SEQ ID NO: 790436 - DNA, 657 bp, Homo sapiens
  misc_feature: 12461.UNK.UNK.UNK.pb.heavy.1.raw 12461
ctatgcgccttgccagcccgctcagacagtatataggaagtagtccttgaccaggcagcccagggccgctgtgcccccagaggtgctcttggaggagggtgccagggggaagaccgatggccccttggtggaggctgaggagacggtgaccagggtttccctggcccagtggtcaaagtagttggtgacgaactggccctactctcgcacagtaatacacggccgtgtccgcggcggtcacagagctcagcttcagggagaactggttcttggacgtgtctactgatatggtgactcgactcttgaggacggttgtagtaggtgctcccactataatagatactcccaatccactccagccccttcctggggctggcggatccagcccagtgtaactactactgctgatggagccaccagagacagtgcaggtgagggacagggtctccgaaggcttcaccagtcctggcccgactcctgcagctgcagctgggacaggacccatctgggagccgccaccagcaggaggaagaaccacaggtgcttcatgttcttgcacaggaggtccatgactctcagaaagcccccgcggaatctacactactaaatcgagcacgtcgtgtatatactgtctgatggcgcgagggaggcgatacg

SEQ ID NO: 790437 - DNA, 701 bp, Homo sapiens
  misc_feature: 12526.44.55.E11.1.pb.heavy.1.raw 12526
ctatgcgccttgccagcccgctcagacagtatataggaagttagtccttgaccaggccagccagggccgctgtgccccagaggtgctcttggaggaggggtgtcaggggaagaccgatgggccccttggtggaggcggaggcgacggtgaccagggttccctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacgagtctgcgtagtatgtgaaatcaccagtataaatgactgagacccactccagcccccttccctggaggcctggcgacccaactcatgtagttgctgctgacggtgagccagaggctgcacaggagagtctctggacccccaggctggactaagcctcctccagactccatcagccgcacctcacactggacaccttttaaaagtccaacaaggagaacccaggctcagccaaaactccatggtgagtctctgtgttcagtgctgatcacgaatggaaacacctcggaatccagtgctgggctcctctcccccccaaacccaacgtgcgagtgctaatcgagcaccggtcgtgtatatactgtctgatggcgccgagggaggcgatacg

SEQ ID NO: 790438 - DNA, 704 bp, Homo sapiens
  misc_feature: 12543.44.27.C05.1.pb.heavy.1.raw 12543
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactggggccacgcctccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccaggccccaaacccttcgatcgcgtctaaatcgagcaccggtcgtgtatatactgtctgatggcgcgagggaggcgatacg

SEQ ID NO: 790439 - DNA, 693 bp, Homo sapiens
  misc_feature: 12555.44.74.G08.1.pb.heavy.1.raw 12555
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggtgacaatgaccagggttccctgcccccagatctcaaaggctccatgcgagctggggtacggacctctcgcacagtagtagacggccgtgtcgtcggatttcaaagaactcattgtcatggagactgtgtctgtggacttgtcgcggtaatcgtaattctgccccggaagtctcgtgcgtaggtgagtgagccaaaaagagggatgattccacccatccactcaagcccttgtccaggggcctggcgcacccagttgatggtataagtagtggaactggtagtacttccagaggccgtgcaggaaagggtcaccgaggaccaaggttgcggcattctagtcccagactgcaccagttgcaccagggactggacacctgttgctgctgccaccacaaagaggaacctccaggtccagtccatggtgatgagctgtgctcccaggggcttctttagaggaggaatgtggttgttatgtgatgctccccctgatagagctactaaatcgagcaccggtcgtgtatatactgtctgatggcgcgagggaggcgatacg

SEQ ID NO: 790440 - DNA, 548 bp, Homo sapiens
  misc_feature: 12559.44.43.D10.1.pb.heavy.1.raw 12559
ctatgcgccttgccagaccgctcagacagtatataggaagtaggtccttgaccaggcagcccagggccgctgtgcccccagaggtgctcctggagcagggcgccagggggaagaccgatggcccttggtggaagctgaggagacggtgaccaggttccctggccccaggggtcgaaccacctccccgacgagctgctatacttttcgggatctcgcacagtaatacacggccgtgtcctcagatctcaggctgctcagctccatgtaggctgtgttatggagggtgttcctgggtcatgggtgactctgccctggacttctgtgcatagcctgtgttaccactgttagggttcatccatccatccactcaagcccttgtccagtggcctgtcgcacccagttgatacataattgggtgaaggtgtatccagaagccttgcaggagaccttcactgaggccccaggcttcttcacctcagcccttactgctagtctaaatcgagcaccggtcgtgtatatactgtctgatgcgcgagggaggcgatacg

SEQ ID NO: 790441 - DNA, 661 bp, Homo sapiens
  misc_feature: 12572.44.19.B08.1.pb.heavy.1.raw 12572
ctatgcgcgccttgccagccccgctcagacagtatataggaagtagtccttgaccaggcagcccagggccgctgtgctctcggaggtgctcctggagcagggcgccagggggaagaccgatgggcccttggtggaggctgatggagacggtgacctggattcctggccccagggttcgaagaaggcccgtggtcattgtggtcatgaagtgggcacagaaatatgtgcctgtgtccacagggtccacgttggtcaatgtaagggaccacctggtttttggacgtgtcccttcgtgaggcgtgagtctgggtcgtcagagaaggactatatccgtatatcgtcattccaataagtgagtgcgatccactccagggcctttccgggggggctgccgcacccagacaacgccctctccaggagtgacgagtgagaagcctgagacggtggcaggtcagcgtgagggtctgtgtgggtttcaccaatgtagggccagactcttttcaccggtgatctgggacaggcccatgaagggatggtcagcagcaggagcgtggagcaaagtgtgtccatggtggggcacaggagtcccccccttactgactcactaaatcgagcaccggtcgtgatagtatagactgatggcgcgagggagggcgatacg

SEQ ID NO: 790442 - DNA, 689 bp, Homo sapiens
  misc_feature: 12619.UNK.UNK.UNK.pb.heavy.1.raw 12619
cgtatcgcctccctcgcgcatcagacagtatatacacgacggtgctcgatttagtgtagtgtgaagggaaaagggtctggagaggagcccagcactagaaagtcggcggtgtttccattcggtgatcagcactgaacacagaggactcaccatggagtttggctgagctgggtttcctcgttgctcttttaagaggtgtccactgtcaggtgcacctggtggagtctggggaggcgtgtccagcctggaggtccctgagactctcctgtgaagcctcggatttagtttcagtgttctggcatgcactgggtccgccaggctccaggcaaggggccgagtggttggcagtgctatagcacatgatggaagttctgatattatgcagactcgtgaaggccgattcaccatctccagagacaattcccggaacattgtgtacttggaaatggtcagcctgagagtcgaggactcgctctgtattactggtgcgagatcgggaggtggtagtagttattaccgggcgcatgactggggccagggaccctggtcaccgtctcctcagcctccaccaagggccatcggtcttcccctggcgcctgctccaggagcacctccgagagcacagcgccctgggctgctgtcaaggactactcttcctatatactgtctgagcggcggcaggcgcatag

SEQ ID NO: 790443 - DNA, 698 bp, Homo sapiens
  misc_feature: 12641.UNK.UNK.UNK.pb.heavy.1.raw 12641
ctatgcgccttgccagcccgctcagacagtatataggaagtagtccttgaccaggcagcccagggccgctgtgctctcggaggtgctcctggagcagggcgccagggggaagaccgatgggcccttgtggaggccgagagacggtgaccagggttccctggcccaggcgtcgaatgaaccgatttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttccctccatgaaatgacacacctgccacccactccagcccctcgcctggagcctggcggacccactgcatattccaattatcgaaggtgaatccagaggctgcacaggagagtctcaggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgactccatgctgggctcgtctcccaggccccaaaccttcgatcgcgtctaaatcgagccagcgtcgtgtatatactgtctgatggcgcgagggaggcgatacg

SEQ ID NO: 790444 - DNA, 700 bp, Homo sapiens
  misc_feature: 12644.44.27.C05.1.pb.heavy.1.raw 12644
cgtatcgcctccctcgcgccatcagacagtatatacacgaccggtgctcgatttagacgcgatcgaagggtttggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctggggaggcgtggcccagtaggggggtccctgagactctcctgtgcagcctctggattcaccttcgataattggaatatgcagtgggtccgccaggctccaggcgagggctggagtgggtggcaggtgtgtcatttcatggaggaaatcaagtctacggtgattccgttgagggccgattcaccatctccagagacaattccgagaacacagtgtctcttcaaatgaacagcctgagactcaggacacggccgtgtatttttgtgcgagactatctgtttccaaatcggttcattcgacgcctggggccagggaaccctggtcaccgtctcctcggcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 790445 - DNA, 602 bp, Homo sapiens
  misc_feature: 12768.UNK.UNK.UNK.pb.heavy.1.raw 12768
cgtatcgcctgccgctcgcgcatagacagtagtcttaccacgaccggtgccgttagccgagagtgtgttgagctctggagcagaggcccagcgggaagcccagggccttgtgagcgaggacgtgaccagggacgcaccatagatctgagcgagttccttgctgctcatttaaaacgtgccagtgtgaggcggtcacgggtggagtctggggaggttggtaaagcctggagtcctagactccctgtgcagctctgattcactttcagtaacgcctggatgactgggtccgccaggctccaggaaggctgggtgggttggccgtattagaaccaaaagctgacgtgggaacagcagactacgctgcacgtgaaagcagattcaccatccaaggatgattcaagatacggtgtctctgcagatgacagcctgacaccggacacagccgcattactgtctgggatggcacggcagggaaccttcacgtctctcagcctccaccagggccatcggtcttcccctggcccctgcccagagcacctcgagagcacagcggctgctgccgtcgatactataactgtctgatgcgcaggcaggcgcatacg

SEQ ID NO: 790446 - DNA, 592 bp, Homo sapiens
  misc_feature: 12820.44.78.H01.1.pb.heavy.1.raw 12820
cgtatcgcctccctcgccggccatcagaccagtatatacacgaccggtgctcgattttagtgtgagtagtttgggttttgggtgccgaagttgctggaggtcacggtcaccacgctgctgaggtgaagaagcctggggccctcagtgacagtctcctgcacggccttctggatacacgttcatcaattatgatattaactgggtgcgacaggccgctggacaagggctggagtggatgggatggatgaagccctatagtgggcaacacgggctttgccagaagttccaagcagagttagtatgaccaggagcacctccccaggtacagtctacatggaactggagcagcctgagatctgaggacacggcccgtgtatttctgtgcgagagccaccagcacctggcttgacttgtggggccaggaacccctggtcaccgtctcctcagcctccaccaagggccatcggtcttcccccctggccgccctgctccagggaggcacctccggagagcaacagcgggctcctgggctgggcctggtcaaggacttacttcctatatactgtctgagcgggctgggcaaggcgcatag

SEQ ID NO: 790447 - DNA, 623 bp, Homo sapiens
  misc_feature: 12823.UNK.UNK.UNK.pb.heavy.1.raw 12823
cccgacacgcttgctagggacttggagctaaggacgacatattgccttttagacagtcgaaaggtgacgccttagctaccactgaacgtttaggcgccagatgcggtctgggatgacctaactcggcagcttatcgatgatctactgcacggctcaaccaaccaggtcttgatgcgcgcgataggactgacgggatcgctacagacattttaactcgctagtaacttaattgagatcctaggggatgggataggaaatagaatccaccctatccacccccccacatagcctgcttggggtgttgagttttacttttatttcgtgttggaatgagttgaacttccgggaagtggagtaatgggtttgttctaacttcccctaaccgcaaagtactagttttttacgagtggcgttgcaagccatagccagtcacaggtaaataaaacaattcaacgtggcggtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttctc

SEQ ID NO: 790448 - DNA, 716 bp, Homo sapiens
  misc_feature: 12827.44.36.D03.1.pb.heavy.1.raw 12827
cgtatcgcctccctcggcgccatcagacagtataatacacgaccggtgctcgatttagctgcgtcacgatctctctttgggagctctcagagaggtgccttagccctggattccaaggcatttccacttggtgatcagcactggaacacagaggactcacatggagttggggctgcgctgggtttccttgttgctattttagaggtgtcactgtgaggtgcggctggtgagtctggggaggcttggtacagcgggggggtccctgagactctcctgtgcagcctctggattcatcttcagtgactatgccatgaactgggtccgccaggctccagggaaggggctggagtgggtttcatatgttacatattgctggagataccacctactacgcagaactctgtgaagggccgattcaccaattccagggacaatgccaagaactcactgtatctggaaatgaacagcctgagagacgaggacacggctgtctacttctgttcgagagatcggccacttggtcagtggctggttttgactactggggccggggaaccctggtcaccgtctcctcagcctccaccaagggcccatcgcgtcttccctgcgccgggccctgctccaggaggcacctccgagagcggacagcggccctgggctgcctggtcaaggactacttcctatatactgtctgagcgggctggcaaggcgcatag

SEQ ID NO: 790449 - DNA, 723 bp, Homo sapiens
  misc_feature: 12831.44.27.C05.1.pb.heavy.1.raw 12831
ctatgcgccttgccagcccgctcaagacagtatataggaagtagtccttgaccaggcagcccagggccgctgtgctctcggaggtgctcctggagcagggcgccaggggggaagaccgatggggcccttggtggaggccgaggagacggtgaccagggtttccctggccccaggcgtcgaatgaaccgattttggaaacagatagtctcgcacaaaaatacacggccgtgtcctgaggtctcaggctgtttcatttgaaagagaccactgtgttctcggaattgtctctggagatggtgaaatcggccctcaaacggaatcaccgtagacttgattttcctccatgaaaatgacacacctgcacccactccagcccctcgcctggagcctggcggaccccactgcatatttccaattatcgaaggtggaatccagagggctgcacaggagagtctcagggacccccctactggggccacgcctcccccagactccacgaattgcacctgacacatgacacctcttaagagggcaacgaggaaaacccagctcagcccaaaactccatggtgagtcctctgtgttcagtgatgatcaccgagtggaaacaccggcgacttccagtgctgggctcgtctcccagggctccccaaacccttcgatcgcgtctaaatcgagcaccggtcgtgtatatactgtctgatggcgcgagggaggcgatacg

SEQ ID NO: 790450 - DNA, 573 bp, Homo sapiens
  misc_feature: 12855.UNK.UNK.UNK.pb.heavy.1.raw 12855
ctatgcgccttgccagcccgctcagacagtatatataggaagtagtccttgaccaggcagcccaggccgctgtgctctcggaggtgctcctgagcagggcgccaggggggaagaaccgatgggcccttggtggaggctgaggagacggtgaccagggttccctggccccacaagtcaagccaggtgctggtggctctcgcacagaaatacacggccgtgtcctcagatctcaggctgctcagttccatgtagactgtacctggggaggtgctcctggtcatactaactctgccttggaacttctggcaaagcccgtgttgccaacctatagggcttcatccatccctccactccagcccttgtccaggcggcctgtcgcacccagttaattatcataattgatgaacgtgtatcagaagccgtgcaggagactgtcactgaggccccaggcttcttcacctcagcagcgtggtgacgtgactccagcaactcggcacccaaaacccaaactactcacactaaatcgagcaccgtcgtgtatatactgtctgatggcgcgagggaggcgatacg

SEQ ID NO: 790451 - DNA, 679 bp, Homo sapiens
  misc_feature: 12865.UNK.UNK.UNK.pb.heavy.1.raw 12865
ctatgcgccttgccagcccgctcagacagtatataggaagtagtccttgaccaggcagccagggccgctgtgcccccagaggtgctcttggaggagggtgccaggggaaagatccgatgggcctgggtggaggcggaggcgacggtgaccagggttccctggcccagagtcaaacgaataataaccatcgagcgccgacttgtctcgcccacagtaatagacggcgtgtcgtcgcctctcaggttgttcatttgaagataaaccgtgttcctggaattgccctggagatggtgaatggccttcacggagtctgcgtagtatgtgaaatcaccagtataatgactgagacccactccagccccttccctggagctggcggaccaactcatgtattggctgctgacggtgagcccagaggctgacaggagagtctctggacccccaggctggactagcttcctccagctcatcaggccacctcgcactggacaccttttaaaagtccacaaggacccagctcagccaaactccatgtgagtcctctgtgtcagtgcgatcccgaatggaaacacctcgaatccagtgctgggctcctctcccccccaaacccaacgtgcgggtgctaaatcgagcaccggtctgtatatacctgtctgatgggcgcgagggaggcgatacg

SEQ ID NO: 790452 - DNA, 642 bp, Homo sapiens
  misc_feature: 12887.44.86.H09.1.pb.heavy.1.raw 12887
cggtatccccccctcctcgcgccatcagacagtatatacacgaccggtgctcgatttagtgctatagacttgggttggggatgcttctgagagtcaaggacctcctgtgcaagaacatgaagcacctgtggtttttctcctgctggtggcagctcccagatgggtcctgtcccagggcagctgcaggagtcgggcccaggactggtgggccttcgggaaccctgtctctcatcttgcactgtctctggagtttcatcagttctgatcattcttggggctggatccgcagcccccagggaggggaatgagtgattggtgacatccattatactggggcgacgtactactctccgtccctcagagtcgtctcaccatttcgagggaccacgtccatgaacgcttctccctgaaactgacctccgtgaccgccgcggcacggccgtttatttctgtgcgaggcgagactggtctttcaatctttgggccgtggcacccctgggtcactgtctcctcagcttccccaaggccatccggtctccccctggcgccctgctccaggagcacctctgggggcacagcggccctgggctgccggtcaggactacttcctatatactgtctgagcgggctggcaaggcgcag

SEQ ID NO: 790453 - DNA, 577 bp, Homo sapiens
  misc_feature: 12894.UNK.UNK.UNK.pb.heavy.1.raw 12894
agagggactcaccatggagtttgggctgaagctgggttttttcctcgttactcttttaagaggtgtccagtgtcaggtgcacctggtggagtctgggggaggcgtggtccagcctgggaggtccctgagactctcctgtgaagcctctggatttagtttcagtagttctggcatgcactgggtccgccaggctccaggcaaggggccggagtggttggcagttatagcatatgatggaacttctagatattatgcagactccgttgaagggcccgattcaccatctccagagacaattcccggaacactctgtacctggaaatgatcagccctgagaggcgaggactcggctctgtattactgtgcgagatcggggaagtggcagcagctattatcgggcgtttcactggggccaggggacactggtcaccgtctcctccaggcctccaccaagggcccaatcggtcttccccctggcgccctgctcaggagcacctccgagagcacagcggccctgggctgcctggtcaaggactacttcctatatactgtctgagcgggctggcaaggcgcatag

SEQ ID NO: 790454 - DNA, 609 bp, Homo sapiens
  misc_feature: 12908.UNK.UNK.UNK.pb.heavy.1.raw 12908
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacggatcgctacagacatttaactcgctagtaacttaattgagatcctaggggatgggataggaaatagaatccacccctatcaccccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggaccccctagtggccaagatggccgctagcgggttccgcagcttttgacctggaccagggtgcatagcctgcccagccttc

SEQ ID NO: 790455 - DNA, 705 bp, Homo sapiens
  misc_feature: 12923.UNK.UNK.UNK.pb.heavy.1.raw 12923
cgtatcgcctccctcgcgccatcagacagtatatacacgacggtgctcgatttagctgcgtcacgatctctcttggggagctctggagagcggagccccagcccagaattcccaggtgttttcatttggtgatcagcactgaacacagaggactcaccatggagttcgggctgagctgggtttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgcccgcgtctgtgaaagccagattcaccctctcaagagatgacttcaagaactcattgattctgcgaatgactaacctgaaaccgaggacacgggcatgtattattgtgtttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactactcctaatatactggtctgagcgggctggcaaggcgcatag

SEQ ID NO: 790456 - DNA, 694 bp, Homo sapiens
  misc_feature: 12954.UNK.UNK.UNK.pb.heavy.1.raw 12954
cgtatcgcctcctcgcgccatcagacagtatatacacgaccggtgctcgatttaagacgcgatcgaaggttgggggccctgggagacgagccagcactggaagtcgccggtgtttccactcggtgatcatcactgaacacagaggactcaccatggagtttgggctgagctgggtttcctcgttgccctctaagaggtgtcatgtgtcaggtgcaattcgtggagtctggggggggcgtggccccagtagggggtccctgagactctcctgtgcagcctctggattcacctcgataattggaatatgcagtgggtccgccaggctccaggcgagggctggagtgggtggcaggtgtgtcatttcatggaggaatcaagtctacggtgattccgttgagggccgattcaccatctccagagacaattccgagaacacagtgtctcttcaaatgaacagcctgagacctcaggacacggccgtgtattttgttgcgagactatcgttccaaatcggttcattcgacgcctggggccagggaacctggtcaccgtctcctcggcctccaccaagggcccatcggtctccccctggcgccctgctccaggagcaccctccgagagcacagcggcccctgggctgcctggtcaaggactacttcctatatactgtctgagcggctggcaaggcgcatag

SEQ ID NO: 790457 - DNA, 610 bp, Homo sapiens
  misc_feature: 12969.UNK.UNK.UNK.pb.heavy.1.raw 12969
gaaggctgggcaggctatgcaccctggtcccaggtcaaaagctgcggaaacccgctagcggccatcttggcactaggggtcccgcagattcatatgtcgtctagcatgcacaatgctgcaaacccagcttgcaatgcccacagcaaagcggccaactttacgccacgttgaattgtttattacctgtgactggctatggcttgcaacgccactcgtaaaactagtactttgcggttaggggaagtagacaaacccattactccacttcccggaagttcaaactcattccaacacgaaataaaagtaaactcaacaccccaagcaggctatgtgggggggtgatagggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagtttaggtcatcccagacgcatctggcgcctaaacgttcagtggtagctaaggcgtcaccttcgactgtctaaaggcaatatgtcgtccttagctccaagtccctagcaagcgttgtcgg

SEQ ID NO: 790458 - DNA, 697 bp, Homo sapiens
  misc_feature: 12972.44.67.G01.1.pb.heavy.1.raw 12972
cgtatcgcctccctcgcgccatcagacagtatatacacgaccggtgctcgatttagagtatacatattgggtttggggggagaggagcccagcactgggattccgagggttttccattcggtgatcagcactgaacacagaggactcaccatggagttttggctgagctgggttctccttgttggacttttaaaaggtgtccagtgtgaggtgcggctgatggagtctggagggaggcttagtccagcctgggggggtcccagagacttccgtgcagcctctgggctcaccgtcagcagcaactacatgagttgggtccgccaggctccaggaaggggctgagtggttcagtcatttatactggtgatttcacatactacgcagactccgtgaagggccgattcaccatctccagggacaattccaggaacacggtttatcttcaatgaacaacctgagaggcgacgacacggccgtctattactgtgcgagacaagtcggcgctcggagtggttattattcgtttgacttctggggccagggaccctggtcaccgtcgcctccgcctccaccaagggcccatcggtcttccccctggcaccctcctccaagagcacctctgggggcacagcggccctgggctgcctggtcaaggactacttcctatatacttctgagcggctggcaaggcgcatag

SEQ ID NO: 790459 - DNA, 714 bp, Homo sapiens
  misc_feature: 13028.UNK.UNK.UNK.pb.heavy.1.raw 13028
cgtatcgcctccctcgccgccatcagacagtatatacacgaccggtgctcgatttagcgctgcgtcacgatctctcttgggggagctctgagagcggagccccagccccagaattcgccaggtgtttcatttggtgatcagcactgaacacagaggacctcaccatggagttcgggcctgagctggggttttccttgttgttattttacaaggtgtcccagagtgaagtgcagttggtggagtccgggggagacttggtccagcctggagggtccctgagactctcctgtgtcgcctctggattcaccatcagtgaccactatatggactgggtccgccaggctccagggaaggggctgggagtggcttggccgcagtaaaacaaagttgccagctttatcacagagtacgcgcggcgtctgtgaaagccagattcaccctctcaagagatgacttcaagaactcattgattctgcgaatgactaacctgaaaaccgaggacacgggcatgtatattgtgttgtgttttatatcaggaaactgtccactgggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 790460 - DNA, 721 bp, Homo sapiens
  misc_feature: 13044.UNK.UNK.UNK.pb.heavy.1.raw 13044
ctatgcgccttggccagcccgctcagacagtatataggaagtagtccttgaccaggcagcccagggccgctgtgctctcggaggtgctcctggagcagggcggccagggggaagaccgatgggcccttggtgggaggccgaggagacggtgaccagggttccctggccccaggcgtcgaatgaaccgattttggaaacagatagtctcgcacaaaaatacacgccgtgtcctgaggtctcaggctgttcatttgaagagacactgtgttctcggaattgtctctggagatggtgaatcggccctcaacggaatcaccgtagacttgattttcctccatgaaatgacacacctgccacccactccagcccctcgcctggagcctggcggacccactgcatattccaaattatcgaaggtgaatccagaggctgcacaggagagtctcagggacccccctactggggccacgcctcccccagactccacgaattgcacctgacacatgacacctcttaagagggcaacgaggaaaaacccagctcagcccaaactccatggtgagtcctctgtgttcagtgatgatcaccgagtggaaaacaccgggcgacttccagtgctgggctcgtctcccagggctcccccaaaacccttcgatcgcgttctaaatcgagcaccggtcgtggtatatatactgtctgatggcgcgagggaggcgatacg

SEQ ID NO: 790461 - DNA, 703 bp, Homo sapiens
  misc_feature: 13062.44.55.E11.1.pb.heavy.1.raw 13062
ctatgcgccttgccagcccgctcagacagtatataggaagttccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgtttcctggaattgtccctggagatggtgaatcgcccttcacggagtctgcgtagtatgtgaaatcaccagtataaatgactgagacccactccagccccttccctggagcctggcggacccaactcatgtagttgctgctgacgtgagcccagaggctgcacaggagagtctctggaccccccaggctggactaagcctcctccagactccatcagccgcacctcacactggacaccttttaaaagtccaacaaggagaaacccagctcagccaaaactccatggtgagtcctctgtgttcagtgctgatcaccgaatggaaacacctcggaatcccagtgctgggctcctctcccccccaaacccaaacgtgcgagtgctaatcgagcaccggtcgtgtatatactgtctgatggcgcgagggaggcgatacg

SEQ ID NO: 790462 - DNA, 674 bp, Homo sapiens
  misc_feature: 13077.44.35.D02.1.pb.heavy.1.raw 13077
ctatgcgccttgccagcccgctcagacagtatatagggaagtagtccttgaccaggcagcccagggccgctgtgcccccagaggtgctcttggaggagggtgccagggggaagaccgatgggccttggtggaggctgaggagacggtggaccagggttccctggcccaggggtcgagccagttcgcccccccgtctctactgtatcgataggaatctctcgcacaataatatacggccgtgtcccggcggtcacagaagtcaatttcagggagaactggttcttggacctgtctagtgacatggtgactcgactcttgaggcgggttgtagttggtggctgccactgttatagatgcgcccaatccactccagtcccttcccggcggactgccgcagccaactccaataataactactgatgtaaccaccagagacattgcaggtgagggacagggtctccgaaggccttcacccgtcctgggcccgactcctgcagctgcacctcggacacgacccatctgggaggtgccaccaggaggagaagaaccacaggtgtttcatgttcttgtgcaggaggccatgagttcagaaagtatcccaaacccaactatcgtgtgctaaatcgagcaccggtcgtgtatatactgtctgatggcgcgagggaggcgatacg

SEQ ID NO: 790463 - DNA, 681 bp, Homo sapiens
  misc_feature: 13094.44.45.E01.1.pb.heavy.1.raw 13094
ctatgcgccttgccagcccgctcagacagtatataggaagtagtccttgaccaggcagccagggccgctgtgctctcggaggtgctcctggagcagggcgccagggggaagaccgatggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcagggacgtcccaggctggaccacgcctcccccaagactccaccagctgaacctgacactggacacctcttaaaagagcaacggagaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgatagtatagactgatggcgcgaggaggcgatacg

SEQ ID NO: 790464 - DNA, 605 bp, Homo sapiens
  misc_feature: 13128.UNK.UNK.UNK.pb.heavy.1.raw 13128
aggctgggcaggctatgcaccctggtccaggtcaaaagctgcggaacccgctagcggccatcttggccactagggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgacctgtctaaaggcaatatgtcgtccttagctccaagtccctagcaagcgtgtcggg

SEQ ID NO: 790465 - DNA, 604 bp, Homo sapiens
  misc_feature: 13133.UNK.UNK.UNK.pb.heavy.1.raw 13133
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaaccattactccacttcccggaagttcaactcattccaacacgaaataaagtaaactcaacaccccaagcaggctatgtgggggggtgataggggtggattctatttcctatcccatccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcgg

SEQ ID NO: 790466 - DNA, 674 bp, Homo sapiens
  misc_feature: 13134.44.53.E09.1.pb.heavy.1.raw 13134
ttgccagcccgctcagacagtatataggaagtagtccttgaccaggcagcccagggccgctgtgctctcggaggtgctcctggagcaggcgccagggggaagaccgatgggcccttggtggaggctgaggagacggtgaccagggttccctggcccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagctttggttctaatacggccaacccactccagccccttccctggagcctggcggacccaggtcatccaggcgttactgaaagtgaatccagaggctgcacaggagagtctaagggactccccaggctttaccaaacctcccccagactccaccaactgcacctcacactggacaccttttaaaatagcagcaaggaaaatccagctcagcccaaactccatggtgagtcctctgtgttcagtcctgatcactggaatgaaaacacctgggaatcccaaggctggggctcctctcccagagctcaacacactctctctaaatcgagcaccggtcgtgtatatactgtctgatggcgcgagggaggcgatacg

SEQ ID NO: 790467 - DNA, 606 bp, Homo sapiens
  misc_feature: 13140.UNK.UNK.UNK.pb.heavy.1.raw 13140
cccgacacgcttgctagggacttggagctaaggacgacatattgccttttagacagtcgaaggtgacgccttagctacactgaacgtttaggcgccagatgcggtctgggatgacctaactcgcagcttatcgatgatctactgcacgctcaccaaccaggtcttgatgcgcgcgataggactgacgggatcgctacagacatttaactcgctagtaactttaatgagatcctaggggatgggataggaaatagaatccaccctatcacccccccccacatagcctgcttggggtgtgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 790468 - DNA, 730 bp, Homo sapiens
  misc_feature: 13151.44.33.C11.1.pb.heavy.1.raw 13151
ctatgcgcttgccagcccgctcagacagtatataggaagtagtccttgaccaggcagcccagggccgctgtgcccccagaggtgctcttggaggagggtgccagggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcctaggctggaccacgcctcccccagactccaccagcttcacctgacactggacacctcttaaaagagcaacgaggaaaacccaggtcagcccaaactccatggtgagtcctctgtgtttcggtgctgatcaccgactggaaacaccgccgacttctggtgctgggctcctctcccagagctccccaaacccaacgagctcactctaaatcgagcaccggtcgtgtatatactgtctgatggcgcgagggaggcgatacg

SEQ ID NO: 790469 - DNA, 618 bp, Homo sapiens
  misc_feature: 13180.44.38.D05.1.pb.heavy.1.raw 13180
cgtatcgcctcctcggcgccatccagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctcaggaaggggctggtgtgggtctcacgtattaatagtgatgggagtagcacaagctacgcgactccgtgaaagggccgattcaccatctccagagacaaacgccaagaacacgctgtatctgcaaaatgaacagtctgagagccgaggacacggctgtggtattactgtgcaagagccggtgcgggagttcggggagttgcatactactactacggtatggacgtctggggccaagggaccacggtcaccgtctcctcagcttccaccaagggcccatcggtcttcccggcgccctgctccaggagcacctctgggggcacagcggccctgggctgcctggtcaaggactacttcctatatactgtctgagcgggctggcaaggcgcatag

SEQ ID NO: 790470 - DNA, 598 bp, Homo sapiens
  misc_feature: 13200.UNK.UNK.UNK.pb.heavy.1.raw 13200
cccgacacgcttgctagggacttggagctaaggacgacatattgcctttagacagtcgaaggtgacgcttagctaccactgaacgtttaggcgccagatgcggtctggatgacctaactcgcagcttatcgatgatctactgcacgctcaaccaaccaggtcttgatgcgcgcgataggactgacgggatcgctacagacatttaactcgctagtaacttaattgagatcctagggatgggataggaaatagaatcaccctatcaccccccacatagcctgcttggggtgttgagtttacttttatttcgtgttggaatgagttgaacttccggaagtggagtaatgggtttgtctacttcccctaaccgcaaagtactagttttacgagtggcgttgcaagccatagccagtcacaggtaataaacaattcaacgtgcgtaaagattggccgcttgctgtgggcattgcaagctgggttgcagcattgtgcatgctagacgacaatatgaatctgcgggacccctagtggccaagatggccgctagcgggttccgcagctttgacctggaccagggtgcatagcctgcccagccttc

SEQ ID NO: 790471 - DNA, 683 bp, Homo sapiens
  misc_feature: 13211.44.45.E01.1.pb.heavy.1.raw 13211
cgtatcgcctccctcgcgccatcagacagtatatacacgaccggtgctcgatttagtgagtcagtaagggaaaggggctgggagaggagcccagcactagaagtcggcggtgttttccattcggttgatcagcactgaacacagaggactcaccatggagttttggctgagctgggtttttcctcgttgctctttaagaggtgtccagtgtcaggttcagctggtggagtctggggaggcgtgtccagcctgggacgtccctgagactctcctgtgttgcgtccggactcagtttcagtgactctgccatgcactggtccgccaggctccaggcaagggctggagtgggtggcagtcatctggtctgatggaagtaaaagaatactatggaaactccgtgaagggccgattctccgtctccagagacaattccaagaacaccgtgtatctacaaatgaacaatttgagagccgaggactcggctctctattattgtacgagcccatcgtttctactgggcccagggagccctggtcaccgtctcctcagctccaccaagggcccatcggtcttccccctggcgccctgctccaggagcacctccgagagcaacagcggccctgggctgcctggtcaaggactacttcctatatactgtctgagcgggctggcaaggcgcatag

SEQ ID NO: 790472 - DNA, 652 bp, Homo sapiens
  misc_feature: 13228.44.57.F02.1.pb.heavy.1.raw 13228
ctatgcgccttgccagcccgctcagacagtatataggaagtagtccttgaccaggcagcccagggccgctgtgcccccagaggtgctcctggagcagggcgccaggggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtcctcgaaatggtgagacgactcttgagggacggagagtagtacgtcgccccagttaaatggatgtcaccaatccactccattcccctccctggggctgccggatccagcccaagaatgatcagaactgatggaaaactccagagacagtgcagatgagagacagggttcccgaaggcctcaccagtcctgggcccgactcctgcagctgcacctgggacaggacccatctgggagctgccaccagcaggaggaaaaccacaggtgcttcatgttcttgcacaggaggtccttgactctcagaaagcatcccaaacccaactatatcgagctaaatcgagcaccggtcgtgtatatactgtctgatggcgcgagggaggcgatacg

SEQ ID NO: 790473 - DNA, 598 bp, Homo sapiens
  misc_feature: 13249.UNK.UNK.UNK.pb.heavy.1.raw 13249
aggctgggcaggctatgcaccctggtccaggtcaaaagctgcggaaaccgctagcggccatcttggccactaggggtcccgcagattcatattgtcgtctagcatgcacaatgctgcaaaacccagcttgcaatgcccacagcaagcggccatctttacgccacgttgaattgtttattacctgtgactggctatggcttgcaacgcccactcgtaaaactagtactttgcggtaggggaagtagacaaacccattactccacttcccggaagttcaactcattccaacacgaaataaaagtaaactcaacaccccaagcaggctatgtgggggtgataggggtggatctatttcctatcccatcccctaggatctcaattaagttactagcgagttaaatgtctgtagcgatcccgtcagtcctatcgcgcgcatcaagacctggttggtgagcgtgcagtagatcatcgataagctgcgagttaggtcatcccagaccgcatctggcgcctaaacgttcagtggtagctaaggcgtcacctcgactgtctaaaggcaatattcgtcttagctccaagtccctagcagcgtgttcgg

SEQ ID NO: 790474 - DNA, 703 bp, Homo sapiens
  misc_feature: 13252.UNK.UNK.UNK.pb.heavy.1.raw 13252
tcgtatcgcctcccaccgcgcccatcagacagtatatacacgaccggtgctcgattagctgcgtcaacgatctctcttgggagctctcagaagaggtgccttagccctgatccaaggcattcacttggtgatcagcctggaacacagaggactcccatggagttggggctgcgctgggttttccttgttgctatttaagaaggtgtccactgtgaggtgcggctggtggagtctgggggaggcttggtacagcggggggggtctgagactctcctgtgcagcctctggattcatcttcagtgactatgccatgaactgggtccgccagctccaggaaggggctggagtgggtttcatatgttaatattgctggagataccacctactacgcagactctgtgaaggccgattcaccaattccagggacaatgccaagaactcactgtatctggaaatgaacagcctgagagacgaggacacggctgtctacttctgttcgagagatcgggccacttggtcagtggctgttttgactactgggccggggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 790475 - DNA, 700 bp, Homo sapiens
  misc_feature: 13262.44.73.G07.1.pb.heavy.1.raw 13262
cgtatcgcctccctcgcgccatcagacagtatatacacgaccggtgctcgatttagctctacgctccagggccgctgtgctctcggcggtggtttccattcggtgatcagcactgaacacagaggactcaccatggaagttgtggctgagctgggttttcctcgttactcttttacgaagaggtgtccagtgtcaggtgccacctggtggagtctggggaggcgtggtccagcctgggaggtccctgagactctcctgtgaagcctctggatttagtttccagtagttctggcatgcactgggtccggccaggctccagggcaaggggccggagtggttggcagttatagcatatgatggaacttctagatattatgcagactccgtgaagggccgattcaccatctccagagacaattcccggaacactctgtacctggaaatgatcagcctgagaggcgaggactcggctctgtattactgtgcgagatcggaagtgggcagcagctattatccgggcgtttccactggggccaggggacactggtcacccgtctcctcagcctccaccaagggccccatcggtcttccccctggcgccctggctcccaggagcacctccgagagcacagcggccctgggctgcctggtcaaggactacttcctatatactgtctgagcgggctggcaaggcgcatag

SEQ ID NO: 790476 - DNA, 718 bp, Homo sapiens
  misc_feature: 13264.UNK.UNK.UNK.pb.heavy.1.raw 13264
ctatgcgccttgcagcgccgctcagacagtatataggaagtagtccttgacaggcgccagggcccgctgtgccccagaggtgctcttggcaggagggcgtgccagggggaagaccgatggcccttggtggaggcggaggcgacggtggaccaggttccctgccccagaagtcaaacgaataataacacaccctccggcgccgacttgtctcgcacagtaatagacgccgtgtcgtcgcctctcaggttgttcatttgagaataagaccgtgttcctggaattgtcctgggagatggtgaatcggcccttcacggagtctgcgtagtatgtgaacatcaccagtataaatgactgagaccactccagcccccttcctggagcctggcgacccaactcatgtagttgtgctgacgggtgagcccagaggctgcacaggagagtctctgggacccccaggctggactaagccctgcctcgcagactccatcagccgcgcacctcacactggacagcccttttaaaagtccaacaaggagaaccagctcagccaaaactctccatggtgagtcctctggtgttcagtgctgatcaccgaatgaaacactcggaatcccagtgctgggctccctctccccgcccccaaacccaacgtgcgagtgcaatcgagcaccggtcgtgtatattacggtctcaatggcgcgggggagggagcgatacg

SEQ ID NO: 790477 - DNA, 645 bp, Homo sapiens
  misc_feature: 13306.UNK.UNK.UNK.pb.heavy.1.raw 13306
ctatgcgcctgccagcccgctcagacagtatataggaagtagtccttgaccaggcagcccagggccgctgtgcccccagaggtgctcctgagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtcctcgaaatggtgagacgactcttgagggacgagagtagtacgtcgcccagtataatggatgtcaccaatccactccattcccctccctgggggctgccggatccagccccaagaatgatcagaactgatggaaactcagagacagtgcagatgagagacagggttcccgaaggcctcaccagtcctgggcccgactcctgcagctgcacctgggacaggacccatctggagctgccaccagcaggaggaaaaaccacaggtgcttcatgttcttgcacaggaggtccttgactctcagaaagcatcccaaacccaagtctatagcactaaatcgagcaccgtcgtgtatatactgtctgatggcgcgagggaggcgatacg

SEQ ID NO: 790478 - DNA, 657 bp, Homo sapiens
  misc_feature: 13316.44.86.H09.1.pb.heavy.1.raw 13316
ctatgcgccttgccagccgctcagacagtacagtatataggaagtagtccttgaccaggcagcccagggccgctgtgccccagaggtgctcctggagcagggcgccagggggaagaccgatgggcccttggtggaagctgaggagacagtgaccaggggtgccacggccccatagattgaaagaccagtctcgcctcgcacagaaataaacggccgtgtccgcggcgggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctggcccgactcctgcagctgcacctgggacaggacccatctgggagctgccaccagcaggaggaaaaaccacaggtgcttcatgttcttgcacaggaggtcttgactctcagaaagcatccccaaacccaagtctatagcactaaatcgagcaccggtcgtgtatatactgtctgatgcgcgagggaggcgatacg

SEQ ID NO: 790479 - DNA, 607 bp, Homo sapiens
  misc_feature: 13318.UNK.UNK.UNK.pb.heavy.1.raw 13318
gaaggctgggcaggctatgcaccctggtccaggtcaaagctgcggaacccgctagcggccatcttggccactagggtcccgcagattcatattgtcgtctagcatgccacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggggtgataggggtggattctatttcctatccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtgtagctaaggcgtcaccttcgactgtctaaaggcaatatgtcgtccttagctccaagtccctagcaagcgtgtcggg

SEQ ID NO: 790480 - DNA, 614 bp, Homo sapiens
  misc_feature: 13325.UNK.UNK.UNK.pb.heavy.1.raw 13325
cgtatcgcctccctcgcgccatcagacagtatatacacgaccgtgctcgatttagacgcgatcgaagggtttgggctgagctgggttttcctcgttgccctcttaagaggtgtcatgtgtcaggtgcaattcgtggagtctgggggaggcgtggccccagtaggggggtcctgagactctcctgtgcagcctctggattcaccttcgataattggaatatgcaggtgggtccgccaggctccaggcgaggggctggagtgggtgctggtgtgtcatttcatggaggaaatcaagtctacggtgattccgttgagggccgattcaccatctccagagacaattccgagaacacagtgtctcttcaaatgaacagcctgagaacctcaggacacggccgtgtatttttgtgcgagactatctgtttccaaaatcggttcattcgacgcctggggccagggaaccctggtcaccgtctcctcggcctccaccaaggcccatcggtcttccccctggcgccctgctccaggagcacctccgagagcacagcggccctgggctgcctggtcaaggactacttcctatatactgtctgagcgggctggcaaggcgcatag

SEQ ID NO: 790481 - DNA, 685 bp, Homo sapiens
  misc_feature: 13350.44.73.G07.1.pb.heavy.1.raw 13350
cgtatcgcctccctcgcgccatcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtctgggggaggcgtggtccagcctgggaggtccctgagactctcctgtgaagcctctggatttagtttcagtagttctggcatgcactgggtccgccaggctccaggcaaggggccggagtggttggcagttatagcatatgatggaacttctagatattatgcagactccgtgaagggccgattcaccatctccagagacaattcccggaacactctgtacctggaaatgatcagcctgagaggcgaggactcggctctgtattactgtgcgagatcgggaagtggcagcagctattatcgggcgtttcactggggccaggggacactggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790482 - DNA, 658 bp, Homo sapiens
  misc_feature: 13377.44.86.H09.1.pb.heavy.1.raw 13377
ctatgcgccttgcagcccgctcagacagtatatagggaagtagtccttgaccaggcagcccagggccgctgtgcccccagaggtgctcctggagcagggcgccaggggggaagaccgatgggcccttgggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgaggacgactcttgagggacggagagtagtacgtccgcccagtataatggatgtcaccaatccactccattcccctccctgggggctgccggatccagccccaagaatgatcagaactgatggaaactccagagacagtgcagatgagagacagggttccccgaaggcctcaccagtcctgggcccgactcctgcagctgcacctgggacaggaccatctgggagctgcccaccagcaggaggaaaaaccacaggtgcttcatgttcttgcacaggaggtccttgactctcagaaagcatcccaaacccaagtctatagcactaaatcgagcaccggtcgtgtatatactgttctgatggcgcgaggaggcgatacg

SEQ ID NO: 790483 - DNA, 668 bp, Homo sapiens
  misc_feature: 13378.UNK.UNK.UNK.pb.heavy.1.raw 13378
ctatgcgccttgccagccccgctcagacagtatataggaagtagtccttgaccaggcagcccagggccgctgtgcccccagaggtgctcctggaagcaggggcgccagggggaagaccgatgggcccttggtggaagctgaggagacagtgaccagggtgccacggcccatagattgaaaggaccagtctcgcctcgcacagaaataaacgcgccgtgtccgcggcggtcacggagtcagtttcaggagaagcggttcatggacgtgtccctcgaaatggtgagacgactcttgagggaccggagagtagtacgtcgccccagtataatggatgtcaccaatccactccattccctccctgggggctgccggatccagccccaagaatgatcagaaactgatgggaaactccagagaccagtgcagatgagagacagggttcccgaaggcctcaccagtcctgggcccgactccctgcagctgcaccctggggacaggaccccatctgggagctgccaccagcaggaggaaaaaccacaggtgcttcatgttcttgccacaggaggtccttgactctcaggaaagccatcccaaacccaagtcctatagcactaaatcgagcaccggtcgtgtatatactgtctgatggcggcgagggaggcgatacg

SEQ ID NO: 790484 - DNA, 731 bp, Homo sapiens
  misc_feature: 13387.UNK.UNK.UNK.pb.heavy.1.raw 13387
cgtatcgcctcctcctcgcgccatcagacagtatatacacgacccggtgctcgatttagtatcacttcagtcgcggggctctgggagaggagcccagcactagaagtcggcgtgtttccattcggtgatcagcactgaaccacagaggactcaccatggagtttgggctgagctgggtttcctcgttgctcttttaagaggtgtccagtgtcaggtgccagctggtggagtctggggaggcgtgtccagcctgggaggtccctgagactcctcctgtgcagcgtctggtccacctcagtacacctatggcatgcactgggtccgccaggcctccaggcaggggctggagtgggtggcactatatggtatgatggaagtaataaatactatgcagactccgtgaaggggcgatcaccatctccagagacaattcaagaacacgctgtatctgcaaatgaacagcctgagagccgaggacacgggctgtgtattactgtgcgaggacatattgtagtactaccacctgctgggactactactacggtatggagcgtctggggccaagggacacggtcaccgtctcctcagcctccaccaagggtcccaatcggtcttccccctggcaccctcctcaagagcacctctgggggcacagcggcccctggggctgcctggtcaaggactacttccttatcatagctgtctgagcggggctggccaagggcgcatag

SEQ ID NO: 790485 - DNA, 720 bp, Homo sapiens
  misc_feature: 13392.UNK.UNK.UNK.pb.heavy.1.raw 13392
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctcccccagactcaccagctgcacctgacactggacacctcttaaaagagcaacgaggaaaacccagctcagcccaaactccatggtgagtcctctgtgttcagtgctgatcaccgaatggaaacaccgccgacttctagtgctgggcctcctctcccagagctccccgcgactgagtgatactaaatcgagcacctcgtgtatatactgtctgatggcgcgaggaggcgatacg

SEQ ID NO: 790486 - DNA, 629 bp, Homo sapiens
  misc_feature: 13404.UNK.UNK.UNK.pb.heavy.1.raw 13404
gtatcgcctccctcgcgccatcagacagtatataccgacgggtgctcgatttagagtgctacgaagggaaagggggactcctggcccacccatggaccaccctttgctcacgcctgctgctgacatccttccatgggtcttgtccagatcacctgaaggagtctgtctacgctggtgaagcccacacagaccctcacgctgactgcaacctcttggttctcatcagagtgatgagcgattgtgggctgggtcgtcacccccagaagcctggagtgcttgcactcatttattgggatgatgatagcgctacagtccatctctgaagagcagactctcatccggagacgcctcaatacgcaggtgatccttgagtggccaacatgcccctgcgacacagccacatactactgcgaacacatgatcaactttataaaagtggtggttatgtgagtggctttgatatctgggggcaagggacaatggtccagtctcttcagcctccaccaagggcccatcggtcttccccctggcgccctctccaggagcacctccgagagcaacagcggcctgggctgcctggtcaaggactacttcctatatactgtctgagcggctggcaaggcgcatag

SEQ ID NO: 790487 - DNA, 610 bp, Homo sapiens
  misc_feature: 13420.44.23.C01.1.pb.heavy.1.raw 13420
ctatgcgccttgccagcccgctcagacagtatataggaagtagtccttgaccaggcagccaggccgctgtgccccagaggtgctcctggagcagggcgccagggggaagaccgatgggcccttggtggaagctgaggagacagtgaccaggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgcccagtataatggatgtcaccaatcactccattcccctccctggggctgcggatccagcccaagaatgatcagaactgatggaaactccagagacagtgcagatgagagacaggttcccgaaggcctcaccagtcctgggcccgactcctgcagctgcacctgggacaggacccatctggagctgccaccagcaggaggaaaaaccacaggtgttcaccctgccccaatccctaatcacgtgtactaaatcgagcaccggtcgtgtatatactgtctgatggcgcgagggaggcgatacg

SEQ ID NO: 790488 - DNA, 681 bp, Homo sapiens
  misc_feature: 13451.44.12.B01.1.pb.heavy.1.raw 13451
ctatggcttgcccagcccggctcgaaaaaaagacagtatataggaagtagtccttgaccaggcagcccaggccgctgtgcccccagaggtgctcttggaggagggtgccaggggaagaccgatccgcggttgggaggctgaggagacgcgtgaccagggttccctggcccccagtggtcaaagtagttggtgacgaactgccctactctcgccacagtaatacacgcccgtgtccgcgcgggcggtcacagagctcagcttcagggagaactggttcgttggacgtgtctactgatatggtgactcgactcttgagggacgggttgtagtaggtgctcccactataatagatactcccaatccactccagcgcccttccctgggggctggcggatccagccccgcagtagtaactactactgggctgatgagccaccagagacagtgcaggtgaggacagggtctccgaaggcttcaccagtcctggccccgactcctgccagctgcgctgggacagggacccatctgggagccgccaccagcaggaggaagaaccacacggtgcttcatgttcttgcacaggaggtccatgactctcagaaagccccgcggaatctacactactaaatcgagcaccggtcgtgtatatacgtgtctgatgcgcgggagggaggcgatacg

SEQ ID NO: 790489 - DNA, 706 bp, Homo sapiens
  misc_feature: 13453.44.55.E11.1.pb.heavy.1.raw 13453
ctatgcgccttgccaagccgctcagacagtatataggaagtagtccttgaccaggcagcccagggccgctgtggcccccagaggtgctcttggaggagggtgccagggggaagaccgatgggcccttggtggaaggcggaggcgacggtgaccagggttccctggccccagaagtcaaacgaataataaccactccgagcgccgacttgtctcgcacagtaatagacggccgtgtcgtcgcctctcaggttgttcatttgaagataaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgaccggtgagcccagaggctgcacaggagagtctctgggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaaacccaacgtgcgagtgctaaatcgagcaccggtcgtgtaatatactgtctgatggcgcgagggaggcgatacg

SEQ ID NO: 790490 - DNA, 681 bp, Homo sapiens
  misc_feature: 13454.UNK.UNK.UNK.pb.heavy.1.raw 13454
ctatgcgccttgccagcccgctcagacagtatataggaagtagtcgcttgaccaggcagcccagggccgctgtgcccccagaggtgctccttggaggagggtgccaggggaagacgcgatgggcccttggtggaggctgaggagacggtgaccagggttccctggcccaggggtcgagccagttcgccccccgtctctactgtatcgataggaatctctcgcacaataatatacggccgtgtccgcggcggtcacagaagtcaatttcagggagaactggttcttggacctgtctagtgacatggtgactcgactcttgagggcggggttgtagttggtgctgccactgttatagatgcgcccaatccactccagtcccttcccggcggaactgccgcagccaactccaataataactactgatgtaaccaccagagacattgcaggtgagggacagggtctccgaaggcttcacccgtcctgggcccgactcctgcagctgcacctcggacacgacccatctgggaggtgccaccaggaggaggaaaacacaggtgtttcatgttcttgtgcaggaggcccatgagtctcagaaagtatccccaaacccaactatcgtgtgcctaaatcgagcaccggtcgtgtatatactgtctgatggcgcaggagggaggcgatacg

SEQ ID NO: 790491 - DNA, 604 bp, Homo sapiens
  misc_feature: 13478.UNK.UNK.UNK.pb.heavy.1.raw 13478
gaaggctgggcaggctatgcaccctggtccaggtcaaagctgcggaacccgctagcggccatcttggcactaggggtcccgcagattcatattgtcgtctagcatgcacaatgcagcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtggggggtgataggggtggattctatttcctatcccatcccctaggatctcaattagttactagcgagttaaatgtctgtagcgatcccgtcagtcctatcgcgcgcatcaagacctggtttgtgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtggtcggg

SEQ ID NO: 790492 - DNA, 688 bp, Homo sapiens
  misc_feature: 13481.UNK.UNK.UNK.pb.heavy.1.raw 13481
ccgtatcgcctccctcgcgccatcagacgtatatacacggaccggtgctcgatttagctctacgctcaggggggagacgagcccagcacttggaagtcgccggtgtttccattcggtgatcatcactgaacacagaggactcaccatggactttggctgagatgggttttcctcgttgctctttagaggtgccagtgtcaggtgcagctagtggagtctggggaggagcggcccagcctgggaactccctgagactctcctgtgcagcctctggattcatcttcaggaccttatgccatgcactgggtccgccaggctcccaggcaagggctggagtggtggcaattatatcagaaagatggaaattgaagaacactacggagactccgagaagggccgattcaccgtctccagagacaattccaggaacacactgcatctgcaatgtacaacctcacaagtgaggacacggctgtctattattgtgcgagagccccctcgagacggtccccgcttgactactggggccaggaaccctggtcaccgtctcctcagcctccaccaagggcccatcggtcttccccctggcgccctgctccaggagcacctccgagagcacagcggccctgggctgcctggtcaaggactacttcctatatactgtctgagcggctggcaaggcgcatag

SEQ ID NO: 790493 - DNA, 668 bp, Homo sapiens
  misc_feature: 13485.UNK.UNK.UNK.pb.heavy.1.raw 13485
ctatgcgccttgccagcccgctcagacagtatataggaagtagtccttgaccaggcagcccagggccgctgtgctctcggaggtgctcctggagcaggcgccaggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggccttcacgagtttccatagtattctttacttccatcagaccagatgactgccacccactccagcccctgcctgagcctggcggaccagtgcatggcagagtcactgaaactgagtccggacgcaacacaggagagtctcaggacgtcccaggctggaccacgcctccccagactccaccagctgaacctgacactggacacctcttaaaagagcaacgagaaaacccagctcagcccaaactccatggtgagtcctctgtgttcagtgctgatcaccgaatggaaacaccgccgacttctagtgctggctcctctccagccctttccttactgactcactaaatcgagcaccgtcgtgtatatactgtctgatggcgcgagggaggcgatacg

SEQ ID NO: 790494 - DNA, 710 bp, Homo sapiens
  misc_feature: 13531.44.27.C05.1.pb.heavy.1.raw 13531
ctatgcgccttgccagcccgctcagacagtatataggaagtagtccttgaccaggcagccagggccgctgtgctctcggaggtgctcctggagcagggccgcccagggggaagaaccgatgggcccttggtgaggccgaggagacggtgaccagggttccctggcccaggcgtcgaatgaaccgatttggaaacagatagtctcgcacaaaaaatacacggccgtgtcctgaggtctcaggctgttcatttgaagagacactgtgtttctcggaattgtctctggagatggtgaatcgcgccctcaacggaatcaccgtagacttgatttcctccatgaaaatgacacacctgccacccactccagcccctcgcctggagcctggcggacccactgcatattccaattatcgaaggtgaatccagagggctgcacaggagagtctcagggacccccctactggggccacgcctcccccagactccacgaattgcacctgacacatgacacctcttaagagggcaacgaggaaaacccagctcagcccaaaactccatggtgagtcctctgtgttcagtgatgatcaccgagtggaaacaccggcgacttccagtgctgggctcgtctcccagccccaaaccttcgatcgcgtctaaatcgagcaccggtcgtgtatatactgtcttgattggcgcgagggaggcgatacg

SEQ ID NO: 790495 - DNA, 647 bp, Homo sapiens
  misc_feature: 13568.UNK.UNK.UNK.pb.heavy.1.raw 13568
cgtatcgcctccctcgcgccatcagtctatactatcacgaccgtgctcgatttagtgctatagacttggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagttttcatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctcctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaagactacttcctatatactgtctgagcggctggcaaggcgca

SEQ ID NO: 790496 - DNA, 723 bp, Homo sapiens
  misc_feature: 13569.UNK.UNK.UNK.pb.heavy.1.raw 13569
cgtatcgcctccctgcgcgccatcagacagtatatacacgaccgggtgctcgatttagcactcgcacgttgggtttgggcgggagagagcccgcgcactgggattccgaggtgtttccattcggtgatcagcactgaacacagagggactcaccatggagttttggctgagctgggttctccttgttggacttttaaaaggtgtccagtgtgaggtgcggctgatggagtctggaggagcttagtccagcctggggggggtcccagagactctcctgtgcagcctctgggctcaccgtcagcagcaactacatgagttgggtccgccagggctccagggaaggggctggagtggcgtctcagtcatttataactggtgatttcacatactacgcagactccgtgaagggccgattcaccatctccagggacacattcgcaggaacacggtttatccttccaatgaacaacctgagaggcgacgaccacggccgtctattactgtgcgagacaagtcggcgcgctcggagtgttattattcgtttgagcttctggggccaggggaaccctggtcaccgtcgctccgcctccaccaagggcccatcggtcttcccccctggcaccctcctccaagagcacctcggggggcacagcggccctggggctgcctggtcaaggactacttcctatataccctgtctgagcgggctggcaaggcgcatag

SEQ ID NO: 790497 - DNA, 731 bp, Homo sapiens
  misc_feature: 13589.UNK.UNK.UNK.pb.heavy.1.raw 13589
cgtatcgcctccctgccgccatcagaccagtatatacagggaccgtgctcgattttagcagacgtctgtcgcggggagctctgagagaggagcccagccctgggattttcagggtgttttcatttggtgattcaggactgaacagagagaactcaccatggagttgggctgaggtggctttttcttgtgactattttaaaaggtgtccagtgtgaggtggccctgttggagtctgggggaggattggcacagccttgggggggtccctgagactcctcctggtgcagcctctggcttcccctttaggagctatgccatgacctgggtccgccaggctccaggaaggggggctcgagtggggtctcgacaattgcgctagtgcaactgacacatacttacggagagtccgtgaagggccgcttcaccatctccagagacaattccggaaacacactttttctggaaatggaacagcctgaagagtcgaagacacggcgcctttatttctgtgcgagccggggggggactggatccacagtgggtgggtggttcaactcctggggccagggagccctggtcaccgtcgccgcagcctccaccaaagggcccatcggtcttcctcctggcacccctcctccaagagcacctctgggggcacagcggccctgggctgcctggtcaaggaactacttcctatatacctgtctgagcgggctgggcaaggcgcatag

SEQ ID NO: 790498 - DNA, 658 bp, Homo sapiens
  misc_feature: 13597.UNK.UNK.UNK.pb.heavy.1.raw 13597
cgtatcgcctcctcgcgccatcagacagtataacacgaccgtgctcgtttagcacacgatagttgtttggggatactttctgagactcatgggcctcctgccaagaacatgaaacactgtggttcttccttcctcctggggcacccgcccagatgggtcgtgtccgaggtgcagctgcaaggagtcgggcccaggacggtgagccttcggagaccctgtccctcacctgcatgtctctggtggttacatcagtagttattattggagttggctgcggcagtccgccgggaagggactggagtggattgggcgcatctataacagtggcagcaccaactacaaccccgccctcagagtcgagtcaccatgtcactagacaggtccaagacagttctccctgaaattgacttctgtgaccgccgcgacacggcgtatattatttgtgcgagagattcctatcgatacagtagagacgggggggcgaactggctcgacccctgggccagggaccctggtcaccgtctcctcagcctccaccagggccatcggtcttcccctggcaccctcctccaagagcacctctggggcacagcggccctggctgctggtcaaggactattcctatatactgtctgagcgggctgggcaaggcgcatag

SEQ ID NO: 790499 - DNA, 664 bp, Homo sapiens
  misc_feature: 13610.UNK.UNK.UNK.pb.heavy.1.raw 13610
ctatgcgccttgccagcccgctcagacagtatataggaagtagtccttgaccaggcagcccagggccgctgtgccccagaggtgctcctggagcagggcgccagggggaagaccgatgggcccttggtggaagctgaggagacagtgacccagggtgccacggccccatagattgaaaggaccagtctcgcctcgcacagaaataaacggccgtgtccgcggcggtcacggaggttccagtttcagggagaagcggtttcatggaacgtgtccctcgaaattggtgagacgactcttgagggaccggagagtagtacgtcgccccagtataatggatgtcaccaatccactccattccctcccctgggggctgccggatccaggccccaagaatgatcaagaacttgatggaaactccagagacagtgcagatgagagacagggttcccgaaggcctcaccagttcctggcccgactcctgcagctgcacctgggacaggacccatctgggagctaccaccagcaggaggaaaaaccacaggtgcttcatgttcttgcacaggaggtccttgattctcagaaaagcatccccaaacccaagtctatcactaaatcgagcaccggtcgtgtatatactgtctgatggcgcgagggaggcgatacg

SEQ ID NO: 790500 - DNA, 677 bp, Homo sapiens
  misc_feature: 13623.44.45.E01.1.pb.heavy.1.raw 13623
cgtatcgcctcctccggcgccatcagacagtatatacacgaccggtgctcgatttagtgagtcagtaagggaagggctggagaggagcccagcactagaagtcggcgcgtgttccattcggtgatcagcactgaacacagaggactcaccatggagtttgggctgagctgggttttcctcgttgctctttaagaggtgtccagtgtcaggttcagctggtggagtctggggaggcgggtccagcctggacgtccctgagactctcctgttgttgcgtccgactcagtttccagtgactctgccatgcactgggtccgccaggctccaggcagggcctggagtgggtggcagtcatctggtctgatggaagtaaagaaatactatggaaactccgtgaagcggccgattctccgttctccagagacaattccaagaacaccgtgtatctacaaatgaacaatttgagagccgaggactcggctctctattattgtacgagccccatcgttctactgggcagggagccctggtcaccgtctcctcagcctccaccaaggcccatcggtcttccctggcgcccctgctccaggagcacctccgagagccacagcggccctggctgcctggtcaaggactacttcctatatactgtctgagcgggctggcaaggcgcatag

SEQ ID NO: 790501 - DNA, 604 bp, Homo sapiens
  misc_feature: 13634.UNK.UNK.UNK.pb.heavy.1.raw 13634
cccgacacgcttgctagggacttggagctaaggacgacatattgcctttagacagtcgaaggtgacgccttagctaccactgaacgtttaggccagatgcgtctgggatgacctaactcgcagcttatcgatgatctactgcacgctcaaccaccaggtcttgatgcgcgcgataggactgacgggatcgctacagacatttaactcgctagtacttaattgagatcctaggggatggataggaatagaatcacccctatcacgccccccacatagcctgcttggggtgttgagtttacttttatttcgtgttggaatgagttgaacttccgggagtggagtaatgggtttgtctactcccctaaccggcaaagtactagtttttacgagtggcgttgcaaagccatagccagtcacaggtaataaaacaattcaacgtgcgtaaagatttggcgcttgctgtggcattgcaagctgggtttggcagcattgtgcatgctagacgacaatatgaatctgcgggacccctagtggccaagatggccgctagcgggttccgcagcttttgacctggaccagggtgcatagcctgcccagccttctc

SEQ ID NO: 790502 - DNA, 708 bp, Homo sapiens
  misc_feature: 13642.44.55.E11.1.pb.heavy.1.raw 13642
cgtatcgcctcctcgcgccatcagacagtatatacacgaccggtgctcgatttagcactcgcacgttgggtttggggggagaggagcccagcactgggattccgaggtgtttccattcggtgatcagcactgaaacacagaggactcaccatggagttttggctgagctgggttctcctgttggacttttaaaaggtgtccagttgtgaggtgcggctgatggagtctggagggaggcttagtccagcctggggggtcccaagagactctcctgtgcagccctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaaccacggtttatcttcaaatgaacaacctgagaggcgacgacacggccgtctattactgtgcgagacaagtcggcgctcggaagtggttattattcgtttgacttctggggccagggaaccctggtcaccgtcgcctccgcctccacccaagggccatcggtcttccccctggcaccctctccaagagcacctctggggggcacagcggccctgggctgcctggtcaaggactacttcctatatactgtctgagcgggctggcaaggcgcatag

SEQ ID NO: 790503 - DNA, 691 bp, Homo sapiens
  misc_feature: 13651.UNK.UNK.UNK.pb.heavy.1.raw 13651
ctattcgccttgccagcccgctcagacagtatataggaagtagtccttgaccaggccagcccagggccgctgtgcccccagaggtgctcctggagcagggcgccaggggaagaccgatgggcccttggtgaagctgaggtgacaatgaccagggtccctgcccccagatctcaaaggctccatgcgagctggggtacggacctctcgcacagtagtagacggccgtgtcgtcggatttcaaagaactccattgtcatggagactgtgtctgtggacttgtccgcggtaatcgtaattctgccccggaagtctcgtgcgtaggtgagtgagccaaaaaggggatgattccacccatccactcaagcccttgtccagggggcctggcgcacccagttgatgtataagtagtggaactggtagtacttcagaggccgtgcaggaaagggtcaccgaggaccaaggttgtggcattctagtccagactgcaccagttgcaccagggactgacacctgttgctgctgccaccacaaagaggaacctccaggtccagtccatggtgatgagcctgtgctcccaggggcttctttagaggaggaatgtggttgttatgtgatgctccccctgataaggctactaaatcgagcaccggtcgtgtatatactgtctgatggcgcgaagggaggcgatacg

SEQ ID NO: 790504 - DNA, 722 bp, Homo sapiens
  misc_feature: 13667.UNK.UNK.UNK.pb.heavy.1.raw 13667
ctatgcgccttgccagcccgctcagacgaggtatataggaagtagttccttgaccaggccaggcccaggggccgctgtgctctcggaggtcgccctggagcagggcgccagggggaagaccgatgggcccttggtggggctgaggagacggtgaccaggccttcctgggccccagttggacagttcctgatataaacacaacacaataataccatgcccgtgtcctcgcgttttcaggttagtcattcgcagaatcaatgagttcttgaagtcatcttctttgagagggtgaatctggcctttcacagacgcggcgttactctgtgataaagctggcaacttttgtttttactggcggccaaagccactccagccccttccctggagcctggcggaccaagtccatatagtgcgtcactggatggtgaatccagaggcgacacaggagagtctcagggaccctccaggctggaccaagtctcccccggacctccaccaactgcacttcactctggacaccttgtaaaataacaacaggaaaaacccagctcagcccgaaactcccatggtgaggtcctctgtgttcagtgctgatcaccaaatgaaaaacacctgggaattctgggggctggcctcgctctccccaagagagatcgtgacgcagctaaatcgagcaccgcgtcgtgtattatactgtctgatggcgcgagggaggcgatacg

SEQ ID NO: 790505 - DNA, 675 bp, Homo sapiens
  misc_feature: 13730.44.45.E01.1.pb.heavy.1.raw 13730
cgtatcgcctccctcgcgccatcagacagtatatacacgaccggtgctcgatttagtgagtcagtaagggaaggggctgggagaggagccagcactagaagtcggcggtgtttccatcggtgatcagcactgaacacagaggactcaccatggagtttgggctgagctgggttttcctcgttgctcttttaagaggtgtccagtgtcaggttcagctggtggagtctgggggaggcgtggtccagcctgggacgtccctgagactctcctgtgttgcgtccggactcagtttcagtgactctgccatgcactgggtccgccaggctccaggcaaggggctggagtggtggcagtcatctggtctgatggaagtaaagaatactatggaaactccgtgaagggccgattctccgtctccagagacaattccaagaacaccgtgtatctacaatgaacaatttgagagccgaggactcggctctctattattgtacgagccatcgttctactgggccagggagccctggtcaccgtctcctcagcctccaccaagggcccatcggtcttccccctggcgccctgctccaggagcacctccgagagcacagcggccctggctgcctggtcaaggactacttcctatatactgtctgagcgggctggcaaggcgcatag

SEQ ID NO: 790506 - DNA, 668 bp, Homo sapiens
  misc_feature: 13757.UNK.UNK.UNK.pb.heavy.1.raw 13757
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggcccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagctttggttctaatacggccaacccactccagccccttccctgagcctggcggacaggtcatccaggcgttactgaaagtgaatccagaggctgcacaggaagtctaaggactccccaggctttaccaaactccccagactccaccaactgcacctcacactgacacctttaaaatagcagcaaggaaaatcagctcagccaaactccatggtgagtcctctgtgttcagtcctgatcactgaatgaaaacacctggaatccccaaggctgggctcctctccagagctcaaacacactctctctaaatcgagcaccgtcgtgtatatactgtctgatggcgcgaggaggcgatacg

SEQ ID NO: 790507 - DNA, 683 bp, Homo sapiens
  misc_feature: 13785.44.27.C05.1.pb.heavy.1.raw 13785
cgtatcgcctccctcgcgccatcagacagtatatacacgaccggtgctcgattagacgcgatcgaaggttgggggccctgggagacgagccagcactggaagtcgccggtgttccactcggtgatcatcactgaacacagaggactcaccatggagtttgggctgagctgggtttcctcgttgccctctaagaggtgtcatgtgtcaggtgcaatcgtggagtctggggaggcgtggcccagtaggggggtccctgagactctcctgtgcagcctctggattcacctcgataattggaatatgcagtggtccgccaggctcaggcgaggggctgagtggtggcaggtgtgtcatttcatggaggaaatcaagtctacggtgattcgtgagggccgattcaccatctccagagacaattccgagaacacagtgtctcttcaaatgaacagcctgagacctcaggacacggccgtgtattttgtgcgagactatctgttccaaaatcggttcattcgacgctgggccaggaaccctggtcaccgtctcctcggcctccaccaagggccatcggtcttccccctggcgccctgctccaggagcacctccgagagcacagcggccctgggctgcctgtcaaggactacttcctatatactgtctgagcgggctggcaaggcgcatag

SEQ ID NO: 790508 - DNA, 691 bp, Homo sapiens
  misc_feature: 13841.UNK.UNK.UNK.pb.heavy.1.raw 13841
ctaatgccgcttgccagcccgctcagacagtatataggaaagtagtccttgaccaggcaggcccagggccgctgtgcccccagaggtgctcctggagcagggcgccaggggaagaccgatgggcccttggtggaaagctgaggtgacaatgacccaggtttccctgcccccagatctcaaaggctccatgcgagctggggtacggactcttcgcacagtaggtagaccggccgtgtcgtcggatttcaaagaactcattgtcccatggagactgtgtctgtggacttgtccgcggtaatcgtaattctgccccggaagttccctcgtgcgtaggtgagtgagccaaaaagagggatgaattccacccatccactcaagccctttgtccaggggcctggcgcacccagtttgatggtataagtagtggaactggtagtactttccagaggccgtgcaggaagggtccaccgaggaccaaggttgcggcattctagtcccagactgcaccagttgcaccagggactggacacctgttgtgctgccaccacaaaagaggaacctccaggtccagtccatggtgatgagctgtgctcccaggggcttctttagaggaggaatgtggttgtcagtagatctaaatcgagccaccggtcgtgtatatactgtctgatggcgcgagggaggcgatacg

SEQ ID NO: 790509 - DNA, 650 bp, Homo sapiens
  misc_feature: 13872.UNK.UNK.UNK.pb.heavy.1.raw 13872
cgaatcgtcgtatcgcctccgcgccatcagacgtatatacacgaccggtgccgatttagtgtagtgtgaagggaaagggggactccttgtgccccaccatggacacactttgctccacgctcctgctgctgaccatcccttcatggggcctgtcccagatcccgtgaaagagtctggccctacattggtgaaacccccacacagaccctcacgctgactgcaccgtctcaggcttctcactcgtcactcctggagaggggcgttgtctggtgcggcagccccccggaaaggccctggagtggatcgcactcacttatggaatgacgatatacgatatagtccttctctgacgaccagactcacgctcactaaggacacgtccaaaaccaggtggccttacattgaccaacgtggaccctgtggacacagcacattttctgtgcccacttcatgaccacaatgaccacgggctttcttcgaaccctggggccaggaatccaggtcaccgtctcatcagcctccaccaagggccatcggtcttccccctggcgccctgctccaggagccctccgagagcacagcggccctgggctgcctggtcaaggactacttccctatatactgtctgagcgggctggcaaggcgcatag

SEQ ID NO: 790510 - DNA, 702 bp, Homo sapiens
  misc_feature: 13895.UNK.UNK.UNK.pb.heavy.1.raw 13895
cgtatcgcctccctcgcgccatcagacagtatatacacgaacggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctcagggaaggggctggagtgcttggccgcagtaaaaacaaagttgccagctttatcacagagtacgccgcgtctgtgaaagccagattcaccctctcaagagatgacttcaagaactcatgattctgcgaatgactaacctgaaaaccgaggacacgggcatgtattattgtgttgtgtttatatcaggaactgtccactggggccagggaaccctggtcaccgtctcctcagcctcccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 790511 - DNA, 696 bp, Homo sapiens
  misc_feature: 13912.UNK.UNK.UNK.pb.heavy.1.raw 13912
ctatgcgccttgccagcccgctcagacagtatataggaagtagtccttgaccaggcagcccagggccgctgtgccccagaggtgctcctggagcagggcgccagggggggaagaccgatgggcccttggtggaagctgaagagacggtgaccattgtcccctggccccaaatatcaaatgcatcgacgtcccaggatcgcctggcgcagtatagacgcctgttgtcgtcgggtctcaggttgctcatttgtaaatggccaacactgttggagtcatcccttgagacggtgaatcttcccttcacagacgcggcgtactctttacttcccaccataacgtttcattctgacgaaagtgatccactcaagccccttcctggagcctgacggaccccaggccaagtgataatcactaagactgaatcctgagactacacaggagagtctcagagaccgccctggctgtgccaagccccccccgactccgccagtcgcccctcgcactggacaccttctaaaaaactacaggaaaatcaagattagcccaaactccatggttggtggtctgtgctcagtgctgatcaccaagtggaaactcctgggaatctcacggctggggctcctctctcttgcgacgacactaaatcgagccaccggtcgtgtatatactgtctgatggcgcgagggaggcgatacg

SEQ ID NO: 790512 - DNA, 729 bp, Homo sapiens
  misc_feature: 13940.44.56.F01.1.pb.heavy.1.raw 13940
ctatgcgccttgccagcccgctcagacagtatataggaagtagtccttgaccaggcagcccagggccgctgtgcccccagaggtgctcctggagcagggcgccagggggaaagaccgatgggcccttggtggaagctgaagagacgggtgaccattgtcccctggcccccaaatattcaaatgcatcgacgtcccaggatcgcctggcgcagtaatagaacgcctgtgtcgtcggggtctcaggttgctcatttgtaaatggccaacactgttggagtcatcccttgagacgggtgaatcttcccttcacagacggccggcgtactctttacttccaccataaacgttttcattctgacgaaagtggatccactcaagcccccttccctggagccctgaacggacccaggccaagtgataatcactaagactgaatcctgagactacacaggagagtctcagagaccgccctggctgtgccaagccccccccgactccgccagtcgcccctcgcactggacaccttctaaaaaaaactacaaggaaaatcaagatttagcccaaactccatggttggtggtctgttgctcagtgctgatcaccaagtggaaactcctggaatctcacggctggggctctctccagagctcccctttgtgtgttcagacgtctgctaaatcgagcaccggtcgtgtatatactgtctgatggcgcgagggaggcgatacg

SEQ ID NO: 790513 - DNA, 678 bp, Homo sapiens
  misc_feature: 13941.44.53.E09.1.pb.heavy.1.raw 13941
cgtatcgcctccctcgcgccatcagacagtatatacacgaccggtgctcgatttagagagagtgtgttgagctctgggagaggagccccagccttgggattccaggtgttttcattcagtgatcaggactgaacacagaggactcaccatggagtttgggctgagctggatttccttgctgctattttaaaaggtgtccagtgtgaggtgcagttggtggagtctgggggaggtttggtaaagcctggggagtcccttagactctccctgtgcagcctctggattcactttcagtaacgcctggatgacctgggtccgccaggctccagggaagggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctggggatggtttcatcgggccagggaaccctggtcaccgtctcctcagcctccaccaagggccatcggtcttcccctggcgccctgctccaggagcacctccgagagcacagcggccctggctgcctggtcaaggactacttcctatatactgtctgagcgggctggcaaggcgcatag

SEQ ID NO: 790514 - DNA, 705 bp, Homo sapiens
  misc_feature: 13942.44.27.C05.1.pb.heavy.1.raw 13942
ctatgcgccttgccagcccgctcagacagtatataggaagtagtcctttgaccaggcagcccagggccgctgtgctctcggaggtgctcctggagcagggcgccagggggaagaccgatgggcccttggtggaggccgaggagacggtgaccagggttccctgccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccaagcccctcgcctggagcctggcggacccactgcatattccaattatcgaaggtgaatccagaggctgcacaggagagtctcagggaccccctactggggccacgcctccccagactccacgaattgcacctgacacatgacacctcttaagagggcaacgaggaaaacccagctcagcccaaactccatggtgagtcctctgtgtttcagtgatgatcaccgagtggaaacaccggcgacttccagtgctgggctcgtctcccaggccccaacccttcgatcgcgtctaaatcgagcaccggtcgtgtatatactgtctgatggcgccgagggaggcgatacg

SEQ ID NO: 790515 - DNA, 735 bp, Homo sapiens
  misc_feature: 13945.UNK.UNK.UNK.pb.heavy.1.raw 13945
ctatgcgccttgccagccccgctcagacagtatataggaagtagtccttgaccaggcagccagggccgctgtgcccccagaggtgctcttggaggagggtgccaggggaagaccgatgggcccttggtgaggctgagggagacggcgaccgtggtcccttggccccaggcgtccatacattggagtagagcatgtcatatctgtatccacgagccccatctctcgcacagtagtagacaggccgtgtcctcggctctcaggctattcatttccagatatatgtgttcttcgaattgtctctggagatggtgaatcggcccttcacgggaatctacataatatttattacttccatcataccatataagtgccacccactccagtccttgcctggagcctggcggacccagtgcatgccatgtctgttgaaggtgaatcccagacgctacacaggagagttttcagggaccctcccaggctggaccacgctccccagactccaccagcttcacctgacactttggacacctcttaaaagagcaacgaggaaaaacccaggtcagcccaaaactccatggtgagtcctctgtgttcggtgctgatccacccgactggaaacaccgccgactttctggtgctgggctcctctcccagagctcccaacccaagtctatagcactaaatcgagcacccggtcgtgtatatactgtctgatggcgcgagggaggcgatacg

SEQ ID NO: 790516 - DNA, 676 bp, Homo sapiens
  misc_feature: 13949.44.35.D02.1.pb.heavy.1.raw 13949
cgtatcgcctccctcgcgccatcagacagtatatacacgaccggtgctcgatttagcacacgatagttgggtttggggatactttctgagactcatgggcctcctgccacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgccgggaagggactgagtggatgggcgcatctataacagtggcagcaccaactacaaccccgccctcaagagtcgagtcaccatgtcactagacaggtccaagaaccagttctcctgaaattgacttctgtgaccgccgcggacacggccgtatattattgtgcgagagattcctatcgatacagtagagacgggggggcgaactggctcgacccctgggccagggaaccctggtcaccgtctcctcagcctccacaagggcccatcggtcttccccctggcaccctcctcaagagcacctctgggggcacagccggccctgggctgcctggtcaaggactacttcctatatactgtctgagcgggcctggcaaggcgcatag

SEQ ID NO: 790517 - DNA, 689 bp, Homo sapiens
  misc_feature: 13979.44.45.E01.1.pb.heavy.1.raw 13979
ctatgcgccttgccagcccgctcagacagtatataggaagtagtcccttgaccaggcagcccagggccgctgtgctctcggaggtgctcctggagcagggcgccaggggaagacgatgggcccccttggtgggggctgaggagacgggtgaccagggctccctggccccagtagaacgatgggctcgtacaataatagagagccgagtcctcgggctctcaaattgttcatttgtagatacacggtgttcttggaattgtctctggagacggagaatcggcccttcacggagtttccatagtattctttacttccatcagacagatgactgccacccactccagccccttgcctggagcctggcggacccagtgcatggcagagtcactgaaactgagtccggacgcaaccacaggagagtctcagggacgtcccagggctggaccacgcctcccccagactccacaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 790518 - DNA, 675 bp, Homo sapiens
  misc_feature: 14056.44.12.B01.1.pb.heavy.1.raw 14056
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggggccccaggactggtgaagccttcggagaccctgtccctcacctgcactgtctctggtggctccatcagcagtagtagttactactggggctggatccgccagccccccagggaagggggctggagtggattgggagtatctattataagtgggagcacctactacaacccgtccctcaagagtcgagtcaccatatcagtagacaacgtccaagaaccagttctccctgaagctgagctctgtgaccgccgcggacacgggccgtgtattactgtgcgagagtagggcagttcgtcaccaaactactttgaccactggggccagggaaccctggtcaccgtctcctcagcctccacccaagggcccatcggtcttcccctggcaccctcctccaaagagcacctctggggggcacagcggccctgggctgcctggtcaaggactacttcctatatactgtctgagcggctggcaaggcgcatag

SEQ ID NO: 790519 - DNA, 658 bp, Homo sapiens
  misc_feature: 14105.44.57.F02.1.pb.heavy.1.raw 14105
ctatgcgccttgccagccgctcagacagtatataggaagtagtccttgaccaggcagcccagggccgctgtgcccccagaggtgctcctggagcagggcgccagggggaagaccgatgggcccttggtggaagctgaggagacagtgaccaggggtgccacggccccatagattgaaagaccagtctcgcctcgcacagaaataaacggccgtgtccgcggcggtcacggaggtcagtttcagggagaagcggttcatggacgtgtccctcgaaaatggtgagacgactcttgaggacggagtagtacgtcgccccagtatatggatgtcaccaatccactccattcccctccctgggggctgccggaatccagccccaagaatgatcagaactgatggaaactccagagacgtgcagatggagagacagggttcccgaagggcctcaccagtcctgggcccgactcctgcagctgcacctgggacaggacccatctgggagctgccaccgcagaggaggaaaaaaccacaggtgcttcatgtttcttggcacaggaggtccttgactctcagaaagcatcccaaacccaactatatcgagctaaatcgagcaccggtcgtgtatatactgtctgattggcgcgagggaggcgatacg

SEQ ID NO: 790520 - DNA, 564 bp, Homo sapiens
  misc_feature: 14117.44.53.E09.1.pb.heavy.1.raw 14117
ctatgcgccttgccagccgctcagacagtatataggaagtagtccttgaccaggcagcccagggccgctgtgcccccagaggtgctcctggagcagggcgccagggggaagaccgatggcccttggtggaagctgaggagacggtgaccgacgtcccctgcccagacatccatcaaatagtagtagtttatgattccccgaaccgtttccttggaggtcccctcgcacagtaataaacagacgtgtcgtcaactctcacgctgttcatttgcaaatacagcatattcttggaattgtctctggagatggtgaatcggcccttcacggagtctgagtaatacttctcacttccatcgtcggagatgactgccacccactccggccccttgcctggagcctggcggacccagtgcaaaccaaatctatcgatgagaacccagaggctacacaggagagtctcagggacctccgggctggaccacgcctcccccaaacccaacacactctctctaaatcgagcaccggtcgtgtatatactgtctgtggcgcgagggaggcgatacg

SEQ ID NO: 790521 - DNA, 613 bp, Homo sapiens
  misc_feature: 14150.UNK.UNK.UNK.pb.heavy.1.raw 14150
gaaggctgggcaggctatgcaccctggtccaggtcaaaaagctgcggaacccgctagcggccatcttggccactagggtcccgcagattcatattgtcgtctagcatggcacaatgctgcaaacccagccttgcaatgcccacagcaagcggccaatctttacgccacgttgaattgtttattacctgtgactggctatgggcttgcaacgccactcgtaaaactagtactttgcggttaggggaagtagacaaacccattactccacttcccggaagttcaactcattccaacacgaaataaaagtaaactcaacaccccaagcaggcttatgtgggggggtgataggggtggattctatttcctatcccatcccctaggatctcaattaagttactagcggagttaaatgtctgtagcgatcccgtcagtcctatcgcgcgcatcaagacctggttggttgagcgtgcagtagatcatcgataagctgcgagttaggtcatcccagaccgcatctgggcgcctaaacgttcagtggtagctaaggcgtcaccttcgactgtctaaaggcaatatgtcgtccttagctcaagtccctagcaagcgtgtcggg

SEQ ID NO: 790522 - DNA, 626 bp, Homo sapiens
  misc_feature: 14151.UNK.UNK.UNK.pb.heavy.1.raw 14151
cccgacacgcttgctagggacttggagctaaggacgacatattgcctttagacagtcgaaggtgacgccttagctaccactgaacgttttaggcggccagatgcggtctgggatgacctaaactcgcagcttatcgatgatctactgcaccgctcaaccaaccaggtcttgatgcgcgcgataggactgacgggatcgctacagacatttaactcgctagtaacttaattgagattcctaggggatgggataggaaatagaatccacccctatcaccgccccacatagcctgcttggggtgttgagtttactttttatttcgtgtttggaaatgagttgaacttccgggaagtggagtaatgggtttggttctactttcccctaaaccggcaaagtaactagtttttacgagtggcgttgcaagccatagccagtcacaggtaataaacaattcaacgtggcgtaaagattggccggcttgctgtgggcattgcaagctgggtttgcagcattgtgcatgctagacgaacaatatgaaatctggcggacccctagtggccaagatgggcgctagcgggttccgcagcttttgacctggaccagggtgcatagcctgcccagccttc

SEQ ID NO: 790523 - DNA, 718 bp, Homo sapiens
  misc_feature: 14154.UNK.UNK.UNK.pb.heavy.1.raw 14154
gatccgtatcgcctcctcgcgccattcagacagtatatacacgaccggtgctcgattagctggcgtcacgatctctcttggggagagcggagccccagccccagaaattcccaggtgttttcatttggtgatcagcactgaacacagaggactcaccatggagttcgggctgagctgggttttccttgttgttatttttacaaggtgtccagagtgaagtgcagttggtggagtccgggggagacttgtccagcccggaggtccctgagactctcctggtcgtcgcctctggattcaccatcagtgaccactatatggactgggtccgccaggctccaggaaggcgggcctggagtggcttggccgcagtaaaaacaaagttgccagctttatcacaggagtacgccgcgtctgtgaaaagccagattcacccctctcaagagatgacttcaaagaactcattgattctgcgaatgactaacctgaaaaccgaggacacgcgggccatgtattattgtgttgtgtttatatcaggaactgtccactggggccagggaaccctggtcaccgtctcctcagcctccaccaaggcccatcggtcttccccctgggcgccctgctccaggagcacctccgagagcacagcggccctggcctgcctggtcaaggacactacttcctatatactgtctgagcgggctggcaaggcgcgcataga

SEQ ID NO: 790524 - DNA, 745 bp, Homo sapiens
  misc_feature: 14172.44.33.C11.1.pb.heavy.1.raw 14172
cgtatcgcctccctcgcgccatcagacagtatataccacgaccggtgctcgatttagagtgagctcgttgggtttggggagctctgggagaggagcccccagcaccagaagtcggcggcggtgtttccagtcggtgatcagccaccgaacacagaggactcaccatggagtttggggctgacctggggttttcctcgttgctctttttaagaggtgtccagtgtccaggtgaagctggtggagtctgggggaggcgtggtccagcctgggaaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagccctgagagccgaggacacggcctgtctactactgtgcgagagatggggctcgtggatacagatatgacatgctctactccaatggtatggacgcctggggccaagggaccacggtcgccgtctcctcagcctccaccaagggcccatcggtcttccccctggcaccctcctccaagagcaacctctgggggcacagcggccctgggctgcctggtcaaggactacttcctatatactgtctgagcgggctggcaaggcgcatag

SEQ ID NO: 790525 - DNA, 700 bp, Homo sapiens
  misc_feature: 14174.44.27.C05.1.pb.heavy.1.raw 14174
cgtatcgcctccctcgcgccatcagacagtatatacacgaccggtgctcgatttagacgcgatcgaagggtttggggcctgggagacgagcccagcactgaagtcgccgtgtttccactcggtgatcatcactgaacacagaggactcaccatggagttttgggctgagctgggttttcctcgttgccctcttaagaggtgtcatgtgtcaggtgcaattcgtggagtctggggaggcgtggccccagtagggggtccctgagactctcctgtgcagcctctggattcaccttcgataattggaatatgcagtgggtccgccaggctccaggcgagggctgagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggctcttccccctggcgccctgctccaggagcacctccgagagcacagcggccctggctgcctggtcaaggactacttcctatatactgtctgagcgggctggcaaggcgcatag

SEQ ID NO: 790526 - DNA, 722 bp, Homo sapiens
  misc_feature: 14216.44.36.D03.1.pb.heavy.1.raw 14216
cgtatcgcctccctcgcgccatcagacagtatatacacgaccggtgctcgattagctgcgtcacgatctctcttgggggagctctggagagcggagccccagccccagaaattcccaggtgttttcatttggtgatcagcactgaacacagaggactcaccatgggagttcgggctgagctgggttttccttgttgttattttacaaggtgtccagagtgaagtgcagttggtggagtccgggggaggacttggtccagcctggaggggtcccctgagactcttcctgtggtcgcctctggattcaccatcagtgaccactatatggactgggtccgccaggctccagggaaggggctggagtggcttggccgcagtaaaaaacaaagttgccagctttatcacagagtacggccgcgtctggtgaaagccagattcaccctctcaagagatgacttcaagaactcattgattctggcgaatgactaacctgaaaaccgaggacacgggcatgtattattgtggttgtgtttatatcaggaaactgtccactggggccagggaaccctggtccaccgtctccttcagcctccaccaaggggcccatcgggtcttccccctggcgccctgctccaggagcacctccgagagcacagcggcctgggctgcctggtcaaggactacttcctatatactgtctgagcgggctggcaaggcgcatag

SEQ ID NO: 790527 - DNA, 689 bp, Homo sapiens
  misc_feature: 14228.44.27.C05.1.pb.heavy.1.raw 14228
ctatgcgccttgccagcccgctcagacagtatataggaagtagtccttgaccaggcagcccagggccgctgtgctctcggaggtgctcctggagcagggcgccaggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactcagcccctcgcctggagcctggcggacccactgcatattccaattatcgaaaggtgaatccagaggctgcacaggagagtctccagggacccccctactggggccacgcctcccccagactccacgaattgccacctgacacatgacaccctcttaagagggcaacgaggaaaacccagctcaaccaaactccatggtgagtcctctgtgttcagtgatgatcaccgagtggaaacaccggcgaacttcctcttcccccaaaccttcgatcgcgtctaaatcgagcaccggtcgtgatagtatagactgatggcgcgagggaggcgatacg

SEQ ID NO: 790528 - DNA, 730 bp, Homo sapiens
  misc_feature: 14234.44.33.C11.1.pb.heavy.1.raw 14234
cgtatcgcctccctcgcgccatcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaaggaaccacggtcgccgtctcctcagcctccaccaaggggcccatcggtcttccccctggcaccctcctccaagagcacctctgggggcacagcggccctgggctgcctggtcaaggactacttcctatatactgtctgagcgggctggcaaggcgcatag

SEQ ID NO: 790529 - DNA, 701 bp, Homo sapiens
  misc_feature: 14235.44.73.G07.1.pb.heavy.1.raw 14235
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagtgtcccctggccccagtgaaacgcccgataatagctgctgccacttcccgatctcgcacagtaatacagagccgagtcctcgcctctcaggctgatcatttccaggtacagagtgttccgggaattgtctctggagatggtgaatcggcccttcacggagtctgcataatatctagaagttccatcatatgctataactgccaaccactccggcccttgcctggagcctggcggacccagtgcatgccagaactactgaaactaaatccagaggcttcacaggagagtctcagggacctcccaggctggaccacgcctccccagactccaccaggtgcacctgacactggacacctcttaaaagagtaacgaggaaaacccagctcagccaaactccatggtgagtcctctgtgttcagtgctgatcaccgaatggaaacaccgccgacttctagtgctgggctcctctcccagagctcccctgagcgtagagctaatcgagcaccggtcgtgtatatactgtctgatggcgcgagggaggcgatacg

SEQ ID NO: 790530 - DNA, 677 bp, Homo sapiens
  misc_feature: 14240.44.36.D03.1.pb.heavy.1.raw 14240
cgtatcgcctccctcgcgccatcagtctatactatcacgaccggtgctcgatttagctgcgtcacgatctctcttgggagctctgagagcggagccccagcccagaattcccaggtgttttcatttggtgatcagcactgaacacagagactcaccatgagttcgggctgagctgggttttcctgttgttattttacaaggtgtcagagtgaagtgcagttggtggagtccggggagacttggtccagcctggagggtcctgagactctcctgtgtcgcctctggattcacatcagtgaccactatatggactgggtccgccaggctcaggaagggctggagtggcttggccgcagtaaaaacaaagttgccagctttatcacagagtacgccgcgtctgtgaaagccagattcaccctctcaagagatgacttcaagaactcattgattctgcgaatgactaactgaaaacgaggacacggcatgtattattgtgttgtgtttatatcaggaactgtccactggggcaggaacctggtcaccgtctcctcagctccaccaaggccatcgtcttccctggcgcctgctcaggagcacctcgagagcacagcggcctgggctgcctggtcaaggactacttcctatatactgtctgagcgggctggcaaggcgcatag

SEQ ID NO: 790531 - DNA, 601 bp, Homo sapiens
  misc_feature: 14241.UNK.UNK.UNK.pb.heavy.1.raw 14241
ccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctagggatgggataggaaatagaatccacccctatcaccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtgcgtaaagatggccgcttgctgtgggcattgcaagctgggtttgcagcattgtgcatgctagacgacaatatgaatctgcgggacccctagtggccaagatggccgctagcggttccgcagcttttgacctggaccagggtgcatagcctgccagccttc

SEQ ID NO: 790532 - DNA, 697 bp, Homo sapiens
  misc_feature: 14254.UNK.UNK.UNK.pb.heavy.1.raw 14254
cgtatcgcctcctcgcgccatcgacagtatcatacagcgacgcgtgctcggatttagctgccgtcacgatctctcttggggagctctgaggcggagccccagccagaattcccaggtgttttcatttgggatcagcatcgaacacagaggactcaccatggagttcgggctgagctgggttttccttgttgttattttacaaggtgtccagagtgaagtgcagttggtgagtccggggagacttggtccagccggaggcgtcctgagactctcctgtgtcgcctctggattcaccatcagtgaccactatatggactgggtccgccaggctccagggaagggactggagtggctgccgcagaaaaacaaagttccagcttatcacaggagtacgccgcgtctgtgaagccagattcaccctctcaagagatgacttcaagaactccattgattctgcgaatgactaacctgaaaacgaggacacggcatgatattatgttgtgtttatcaggaacgtccactggggccagggccaggagcctcaggcaccggtctcctcagcctctcgcagggcccatcggtcttccccctggcgccctgctcaggagccaccttccgagagcacagcggccccgggctgcctggtcaaggacacttccatatgatacctgtctgagcggctggccaaggcgcatag

SEQ ID NO: 790533 - DNA, 652 bp, Homo sapiens
  misc_feature: 14255.44.23.C01.1.pb.heavy.1.raw 14255
ctatgcgccttgccagcccgctcagacagtatataggaagtagtccttgaccaggcagcccagggccgctgtgcccccagaggtgctcctggagcaggcgccagggggaagaccgatgggcccttggtggaagctgaggagacagtgaccagggtgccacggccccatagattgaaagaccagtctcgcctcgcacagaaataaaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcccccaatccctaatcacgtgtactaaatcgagcaccggtcgtgtatatactgtctgatggcgcgagggaggcgatacg

SEQ ID NO: 790534 - DNA, 677 bp, Homo sapiens
  misc_feature: 14277.44.74.G08.1.pb.heavy.1.raw 14277
cgtatcgcctccctcgcgccatcagacagtatatacacgaccggtgctcgatttagtagctctatcaggggagcatcacataacaaccacattcctcctctaaaggaagccctggagcacagctcatcaccatggactggacctggaggttcctctttgtggtgcagcagcaacaggtgtccagtccctggtgcaactggtgcagtctgggactagaatgccgcaaccttggtcctcggtgacccttttctgcacggcctctggaagtactaccagttccactacttataccatcaactggtgcgccaggcccctggacaaggcttgagtggatggtggaatcatccctctttttgctcactcacctacgcacgagacttccggggcagaattacgattacgcggacaagtccacagacacagtctccatgacaatgagttcttgaaatccgacgacacggccgtctactactgtgcgagaggtccgtaccccagctcgcatggagcctttgagatctggggcagggaaccctggtcattgtcacctcagcttccacaaggcccatcgtcttcccctggcgccctgctccaggagcacctctggggcacagcggccctggctgcctggtcaaggactacttcctatatactgtctgagcggctggcaaggcgcatag

SEQ ID NO: 790535 - DNA, 706 bp, Homo sapiens
  misc_feature: 14278.UNK.UNK.UNK.pb.heavy.1.raw 14278
cgtatcgcctccctcgcgccatcagacagtatatacacgaccggtgctccgattttagcctgcgtcacgatctctcttggggagctctgagagcggagccccagccccagaattcccaggtgttttcatttggtgatcagcactgaacacagaggactcaccatggagttcggctgagctgggttttccttgttgttattttacaaaaggtgtccagagtgaaagtgcagttggtggagtcgggagacttggtccagcctggagggtccctgagactctcctgtgtcgcctctggattcaccatcagtgacccactatatggactggtccgccaggctccaggaaggggctggagtggctgccgcagtaaaaacaaagttgccagctttatcacagagtacgccgcgcgtctgtggaaagccagattcacctctcaagagatgacttcaagaactcattgattctgcgaatgactaacctgaaaaccgagggacacggcatgtattatttgtgttgtgtttatatcaggaactgtccactggggcccagggaaccctggtcaccgtctctcagcctccaccaagggcccatcggtcttccccctggcgcctgctccaggagcacctccgagagcacagcggcctgggctgcctggtcaaggactacttcctatatactgtctgagcgggctggcaagcgcgcatag

SEQ ID NO: 790536 - DNA, 672 bp, Homo sapiens
  misc_feature: 14373.UNK.UNK.UNK.pb.heavy.1.raw 14373
cgtatcgcctccctcgcgccatcagacagttatacacgacggtgctccgatttagtgctatagacttgggtttggggatgctttctgagagtcaaggacctcctgtgcaagaacatgaagcacctgtggttttttcctcctgctggtggcagctcccagatgggtcctgtcccaggtgcagctggcagagtcgggccccaggactggtgaggccttcggaaccctgtctctcatctgcactgtctctggagtttccatcagttctgatcattcttgggggctggatccggcagccccagggaggggaaatggagtggaattggtgacatccattatactggggcgacgtactactcttccgtccctcaaagagtcgtctcaccatttcgagggacaacgtccatgaaaccgcttctcctgaaaactgaacctcccgtgaccgccccgcggcacacgggccgtttaatttctgtggcgaaggcgagctccgtctttcaattctatgcccgtggcaccctggtcactgtctcctcagcttccaccaagggcccatcggtcttcccctggcgccctgctccaggaggcacctctgggggcacagcgggcctgggctggcctggtcaaaggactacttcctatatactgtctgagcgggctggccaaggcgcatag

SEQ ID NO: 790537 - DNA, 710 bp, Homo sapiens
  misc_feature: 14389.UNK.UNK.UNK.pb.heavy.1.raw 14389
ctatgcgccttgccagcccgctcagacagtatataggaagtagtccttgaccaggcagcccagggccgctgtgcccccagaggtgctcttggaggagggtgccagggggaagaccgatggcccttggtggaggctgaggagacggtgaccgtggtcctttggccccagacgtccataccgtagtagtagtcccagcaggtggtagtactacaatatgtcctcgcaacagtaatacacagccgtgtcctcggctctcaggctgtcatttgcagatacagcgtgttcttggaattgtctctggagatggtgaatcggcccttcacggagtctgcatagtattattacttccatcataccatataagtgccacccactccagcccttgctggagcctggcggacccagtgcatgccataggtactgaaggtgaatccagacgctgcacaggagaggtctcagggacctcccaggctggaccacgcctccccagactccaccagctgcacctgacactggacacctcttaaagagcaacgaggaaaacccagctcagcccaaactccatggtgagtcctctgtgttcagtgctgatcaccgaatggaaacaccgccgacttctagtgctgggctcctctccccccccgcgactgagtgatataaatcgagcacgtcgtgtatatactgtcgatggcgcgaggggcgaatacgat

SEQ ID NO: 790538 - DNA, 706 bp, Homo sapiens
  misc_feature: 14392.44.36.D03.1.pb.heavy.1.raw 14392
cgtatcgcctcctcgcgccatcagacagtatatacacgaccggtgctcgatttagctgcgtcacgatctctcttggggagctctgagagcggagccccagccccagaattcccaggtgtttttcatttggtgatcagcactgaaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggttcttccccctggcgccctgctccaggagcacctccgaagcacagcggccctgggctgcctggtcaaggactacttcctatatactgtctgagcgggctggcaaggcgcatag

SEQ ID NO: 790539 - DNA, 599 bp, Homo sapiens
  misc_feature: 14398.UNK.UNK.UNK.pb.heavy.1.raw 14398
cccgacacgcttctaggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctagggatgggataggaaatagaatccacccctatcacccccccacatagcctgcttggggtgttgagtttactttatttcgtgttggaatgagttgaacttcggaagtggagtaatgggtttgtctacttcccctaaccgcaaagtactagttttacgagtggcgttgcaagcatagccagtcacaggtaataaacaattcaacgtggcgtaaagattggccgcttgctgtgggcattgcaagctgggtttgcagcattgtgcatgctagacgacaatatgaatctgcgggaccctagtggccaagatggccgctagcgggttccgcagcttttgacctggaccagggtgcatagcctgccagccttc

SEQ ID NO: 790540 - DNA, 702 bp, Homo sapiens
  misc_feature: 14400.44.27.C05.1.pb.heavy.1.raw 14400
cgtatcgcctcctcgcgccatcagacagtatatacacgaccggtgctcgatttagacgcgatcgaagggtttggggctgggagacgagccaagcactggaagtcgccggtgtttccactcggtgatcatacactgaaaaccagaggactcaccaggtttttggagctgagctggggttttcctcgttgccctcttaagaggtgtcatgtgtcaggtacaattcgtggagtctggggaggcgtggcccagtagggggggtccctgagactctgtgtgcagcctctggattcaccttcgataattggaatatgcagtgggtccgccaggctccaggcgaggggctggagtgggtgcaggtgtgtcatttcatggaggaaatcaagtctacggtgattccgttgaggccgattcaccatctccagagacaattccgagaacacagtgtctcttcaaatgaacagcctgagacctcaggacacggccgtgtatttttgtgcgagactatctgtttccaaaatcggttcattcgacgcctggggccaggaaccctggtcaccgtctcctcggcctccaccaagggcccatcggtcttcccccctggcgcctgctccaggagcacctccgagagcacagcggccctgggctgcctggtcaaggactacttccctatatactgtctgagcgggctggcaaggcgcatag

SEQ ID NO: 790541 - DNA, 682 bp, Homo sapiens
  misc_feature: 14404.44.45.E01.1.pb.heavy.1.raw 14404
ctatgcgccttgccagcccgctcagacagtatataggaagtagtccttgaccaggcagcccagggcgctgtgctctcggaggtgctcctggagcagggcgccagggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgctggagcctggcggacccagtgcatggcagagtcactgaaactgagtccggacgcaacacaggagagtctcagggacgtcccaggctggaccacgcctcccccagactccaccagctgaacctgacactggacacctcttaaaagagcaacgaggaaaacccagctcagccgccaaactccatggtgagtcctctgtgttcagtgctgatcacgaatggaaacaccgccgacttctagtgctgggctcctctcccagcccctttcccttactgactcactaaatcgagcaccggtcgtgtatatactgtctgatggcgcgagggaggcgatacg

SEQ ID NO: 790542 - DNA, 684 bp, Homo sapiens
  misc_feature: 14405.44.35.D02.1.pb.heavy.1.raw 14405
cgtatcgcctccctcgcgccatcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttttattattggagttggctgcggcagtccgccgggaagggactggagtggattgggcgcatctataacagtggcagcaccaactacaaccccgccctcaagagtcgagtcaccatgtcactagacaggtccaagaaccagttctccctgaaattgacttctgtgacccgccgcggacacggccgtatattattgtgcgagagattcctatcgatacagtagagacgggggggccgaactggctcgacccctggggccagggaaccctggtcaccgtctcctcagcctccaccaagggcccatcggtcttccccctggcaccctcctccaagagcacctctggggcacagcggcccctcgggctgcctggtcaaggactacttcctatatactgtctgagcgggctggcaaggcgcatag

SEQ ID NO: 790543 - DNA, 723 bp, Homo sapiens
  misc_feature: 14415.44.85.H08.1.pb.heavy.1.raw 14415
ctatgcgccttgccagcccgctcagacagtatataggaagtagtccttgaccaggcagcccagggccgctgtgcccccagaggtgctctttggaggagggtgccagggggaagaccgatgggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggctcctctcccagagctccccgcgactgagtgatactaaatcgagcaccggtcgtgtatatactgtctgatggcgcgagggaggcgatacg

SEQ ID NO: 790544 - DNA, 711 bp, Homo sapiens
  misc_feature: 14444.44.56.F01.1.pb.heavy.1.raw 14444
ctatgcgcctgccagcccgctcagacagtatataggaagtagtccttgaccaggcagcccagggccgctgtgcccccagaggtgctcctggagcagggcgccaggggaagaccgatgggcccttggtggaagctgaagagacggtgaccattgtcccctggccccaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagcccccccccgactccgccagtcgcccctcgcactggacaccttctaaaaaaactacaaggaaaatcaagattagcccaaactccatggttggtggtctgtgctcagtgctgatcaccaagtggaaactcctgggaatctcacggctggggctcctctcccagagctccctttgtgtgttcagacgtctgctaaatcgagcaccggtcgtgtatatactgtctgatggcgcgagggaggcgatacg

SEQ ID NO: 790545 - DNA, 731 bp, Homo sapiens
  misc_feature: 14451.44.33.C11.1.pb.heavy.1.raw 14451
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggcgaccgtggtcccttggccccaggcgtccataccatttggagtagagcatgtcatatctgtatccacgagccccatctctcgcacagtagtagacagccgtgtcctcggctctcagggctattcatttccagatatagtgtgttcttcgaattgtctctggagatggtgaatcggcccttcacggaatctacataatatttattacttccatcataccatataagtggccacccactccagtccctttgcctggagcctggcggaccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgactttctggtgctgggctcctctcccagccccaaacccaacgagctcactctaaatcgagcaccggtcgtgtatatactgtctgatggcgcgaggaggagcgatacg

SEQ ID NO: 790546 - DNA, 614 bp, Homo sapiens
  misc_feature: 14457.UNK.UNK.UNK.pb.heavy.1.raw 14457
cccgacacgcttgctagggacttggagctaaggacgacatattgcctttagacagtcgaaggtgacgccttagctaccactgaacgtttaggcgccagatgcggtctgggatgacctaactcgccagcttatcgatcgatctactgccacggctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagctggagtaatgggtttgtctacttcccctaaccgcaaagtactagttttacgagtggcgttgcaagccatagccagtcacaggtaataaacaattcaacgtggcgtaaagattggccgcttgctgtgggcatttgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 790547 - DNA, 641 bp, Homo sapiens
  misc_feature: 14459.UNK.UNK.UNK.pb.heavy.1.raw 14459
cgtatcgcctccctcgcgccatcagaccagtatatacacgacggtgctcgatttagtgctatagacttgggttgggatgcttctgagagtcaggaccctcctgtgcaagaacatgaagcacctgtggtttttcctcctgctggtggcagctccagatggtcctgtcccaggtgcagctgcaggagtcggggcccaggactggtgaggccttcgggaacctgtctctcatctgcactgtctctgagtttccatcagttctgatcattcttggggctggatccggcagcccccagggagggaatggagtggattggtgacatccattatactgggcgacgtactactctccgtccctcagagtcgtctcaccatttcgagggacacgtccatgaaccgctttctccctgaaactgacctccgtgaccgccgcggaacggccgtttatttttgtgcgaggcgagactggtctttcaatctatgggggccgtggcaccctggtcactgtctctcagcttccaccaagggcccatcggtcttcccctggcgcctgctccaggagcactctgggggcacagcggccctgggctgcctggtcaaggactacttcctatatactgtctgagggctggcaaggcgcatag

SEQ ID NO: 790548 - DNA, 691 bp, Homo sapiens
  misc_feature: 14465.UNK.UNK.UNK.pb.heavy.1.raw 14465
cgtatcgcctccctcgcgccatcagacagtatatacacgacggtgctcgatttagctgcgtcacgatctctcttgggggagagcggagccccagccccagaattcccaggtgttttcatttggtgatcagcactgaacacagaggactcaccatggagttcgggctgagctggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccagggaaggggctggagtggctggccgcagtaaaaacaaagttgccagcttatcacagagtacgccgcgtctgtgaaagccagattcaccctctcagagatgacttcaagaactcattgattctgcgaatgactaacctgaaaaccgaggacacgggcatgtattattgtgttgtgtttatatcaggaactgtccactggggccaggaaccctggtcaccgtctcctcagcctccaccaagggcccatcggtcttccccctggcgcctgctccaggagcacctccgagagcacagcggccctgggctgcctggtcaaggactacttcctatatactgtctgagcgggctggcaaggcgcatag

SEQ ID NO: 790549 - DNA, 698 bp, Homo sapiens
  misc_feature: 14483.44.36.D03.1.pb.heavy.1.raw 14483
cgtatcgcctccctcgcgccatcagacagtatatacacgaccggtgctcgatttagctgcgtcacgatctctcttggggagctctgagagcggagccccagccccagaattccaggtgtttcatttggtgatcagcactgaacacagaggactcaccatggagttcgggctgagctgggtttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccagggaagggctggagtggcttggccgcagtaaaaacaaagttgccagctttatcacagagtacgccgcgtctgtgaaagccagattcaccctctcaagagatgacttcaagaactcattgattctgcgaatgactaacctgaaaaaccgggacacgggcatgtattattgtgttgtgtttatatcaggaactgtccactggggccagggaaccctggtcaccgtctcctcagctccaccaagggcccatcggtcttcccctggcgccctgctccaggagcacctccggaagcacagcggcccgggctgcctggtcaaggactacttcctatatactgtctgagcgggctgcaaggcgcatag

SEQ ID NO: 790550 - DNA, 593 bp, Homo sapiens
  misc_feature: 14485.UNK.UNK.UNK.pb.heavy.1.raw 14485
cccgacacgctgctagggacttggagctaaggacgacatattgcctttagacagtcgaaggtgacgcctagctaccactgaacgttaggcgccagatgcggtctgggatgacctaactcgcagcttatcgatgatctactgcacgctcaccaaccaggtcttgatgcgcgcgataggactgacgggatcgctacagacatttaactcgctagtaacttaattgagatcctagggatgggataggaaatagaatcacccctatcaccccccacatagcctgcttggggtgttgagtttactttttatttcgtgttggaatgagttgaacttccggaagtggagtaatggtttgtctacttccctaaccgcaaagtactagttttacgagtggcgttgcaagccatagccagtcacaggtaataaacaatcaacgtggcgtaagattggccgctgctgtgggcattgcaagctggttgcagcatttgtgcatgctagacgacaatatgaatctgcgggacccctagtgccaagatggccgctagcgggttccgcagcttttgacctggaccagggtgcatagcctgccagccttc

SEQ ID NO: 790551 - DNA, 677 bp, Homo sapiens
  misc_feature: 14494.44.6.A06.1.pb.heavy.1.raw 14494
cgtatcgcctccctcgcgccatcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcacctcagcttccaccaagggcccatcggtcttccccctggcgccctgctccaggagcacctctggggggcacagcggccctgggctgcctggtcaaggactacttcctatatactgttctgagcgggctggcaaggcgcatag

SEQ ID NO: 790552 - DNA, 690 bp, Homo sapiens
  misc_feature: 14498.UNK.UNK.UNK.pb.heavy.1.raw 14498
cgtatcgcccctccctcgcgccatcagacagtatatacacgccaccggtggctcgatttagtgagtcagtaagggaaaggggctggagacggaggcccagcactagaagttcggcggtgtttccattcggtgatcagcactgaaacacagaggactcaccatggagtttggggctgagctggttttcctcgttgctcttttaagaggtgtccagtgtcaggtttcagctggtggagtctcggggagggcgtgtccagcctgggacgctccctgagactctcctgtgttgcgtccggactccagtttcagtgactctgccatgcactgggtccgccaggctcaggcaaggggctggagtgggtggcagtcatctgtctgatggaagtaaagaatactatggaaactccgtgaagggccgattctccgtctcagagacaattccaagaacaccgtgtatctacaaatgaacaattgagagccgaggactcggctctctattattgtacgagcccatcgttctactggggccagggagccctggtcaccgtctcctcagcctccaccaaggggccccatcgcgtcccctggcgccctgctccaggagccacctccgagagcacagcggccctgggctgcctggtcaaggactacttcctatatactgtctgagcgggctggcaaggcgcatag

SEQ ID NO: 790553 - DNA, 731 bp, Homo sapiens
  misc_feature: 14552.44.33.C11.1.pb.heavy.1.raw 14552
cgtatcgcctccctcgcaccatcagacagtatatacacgaccggtgctcgatttagagtgagctcgttgggttggggagctctggagaggagcccagcaccagaagtcggcggtgtttccagtcggtgatcagcaccgaacacagaggactcaccatggagtttgggctgacctgggtttttcctcgttgctcttttaagaggtgtccagtgtcaggtgaagctggtggagtctgggggaggcgtgtccagcctgggagggtccctgagactctcctgtgtagcgtctggattcaccttcaacagacatggcatgcactgggtcgcgccaggctccagggcaagggactgagtgggtggcacttatatgtatgatggaagtaataaaatttatgtagattccgtgaaggggccgattcaccatctccagagacaattcgaagaacacactatatctggaaaatgaatagcctgagagcgaggacacggctgtctactactgtgcgaagagatggggctcgtggatacagatatgacatgctctactccaatggtatggacgcctgggccaagggaccacggtcgcccgtctcctcagcctccaccaagggcccatcggtcttccccctggcacccctcctccaagagccacctctgggggcacagcggccctgggctgcctggtcaaggactacttcctatatactgtctgagcggtggcaaggcgcatag

SEQ ID NO: 790554 - DNA, 607 bp, Homo sapiens
  misc_feature: 14591.UNK.UNK.UNK.pb.heavy.1.raw 14591
cgtatcgcctccctcgcgccatcagacagtatatacacgaccggtgtcgatttagtacacgtgattagggattgggcagggtgaacacctgtggtttttcctcctgctggtggcagctcccagatgggtcctgtcccaggtgcagctgcaggagtcggcccaggactggtgaggccttcgggaaccctgtctctcatctgcactgtctctggagtttccatcagttctgatcattctgggctggatccggcagccccagggaggggaatggagtggattggtgacatccattatactggggcgacgtactactctccgtcctcaagagtcgtctcaccatttcgagggacacgtccatgaaccgcttctccctgaactgacctccgtgacgccgcggacacgccgtttatttactgtgcgaggcgagactggtctttcaatctatgggccgtggcaccctggtcactgtctcctcagcttccaccaagggcccatcggtcttccccctggcgccctgctccaggagcacctctggggcacagcggcctgggctgcctggtcaaggactacttcctatatactgtctgagcggctggcaagcgcatag

SEQ ID NO: 790555 - DNA, 609 bp, Homo sapiens
  misc_feature: 14658.UNK.UNK.UNK.pb.heavy.1.raw 14658
cccgacacgcttgctagggacttggagctaaggacgacaatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacggatcgctacagacatttaactcgctagtaacttaaatgagatcctaggggatggataggaatagaatccacccctatcacccccccacatagcctgcttggggtgttgagttaacttttatttcgtgttggaatgagttgaacttccgggaagtgagtatgggtttgtctacttcccctaaccgcaaaagtactagttttacgagtggcgttgcaagccaataagccagtccacaggtaataaacaattcaacgtggcgtaaaaagattggccgctgctgtgggcatgcaagctgggtttgcagcattgtgcatgctagacgacaatatgaatctgcgggacccctagtggccaagatggccgctaagcgggttccgcagcttttgacctggaccagggtgcatagcctgcccagccttc

SEQ ID NO: 790556 - DNA, 527 bp, Homo sapiens
  misc_feature: 14671.UNK.UNK.UNK.pb.heavy.1.raw 14671
ggcgcgctatgcccctggccggtcagctgcggaaccgcagcgccactggccccaggggtccgcagatcatattgtcgtcagcatgcacatgctgcaacccagctgcaagcccgcagcggcctctttacgccacgtgattgttattacctgtgactggctatggcttgcacgccactcgtaaaacagatctttgcggttaggggaagtagacaacccatactcccccctcccggagttcaactcattccacgaatagaaactcaacaccccaagcaaggcgctgggggggtgatagggtggatctttccatcccatcccctaggatctcatagttactgcgagtaaatgctgtagcgatccgtcagtcctatcgcgcgcatcaagacctggttggttgagcgtgcagtagatcatcgataactgcgagttaggtcatcccagaccgctctggcgccaaacgtcatggtgcaaaggcgtcacttcgactgtcaggcaatatggtccttgccagtcctaagcgtgtcggg

SEQ ID NO: 790557 - DNA, 581 bp, Homo sapiens
  misc_feature: 14672.44.53.E09.1.pb.heavy.1.raw 14672
ctatgcgccttgccagcccgctcagacagtatataggaagtagtccttgaccaggcagcccagggccgctgtgcccccagaggtgctcctggagcagggcgccagggggaaagaccgatgggcccttggtggaagctgaggagaacggtgaccgacgtccccctgccccagacatccatcaaatagtagtagtttatgattccccgaaccgtttccttggaggtccccctcgcacagtaataaacagacgtgtcgtcaactctcacgctgtttcatttgcaaatacagcatattcttggaattgtctctggagatggtgaatcggccctcttcaccggaagtctgagtaatacttctcacttccatcgtcggagatgactgccacccactccgggccccttgcctggagcctggcggacccagtgcaaaccaaatctatcgaatgaggaacccagaggctacacaggagagtctcagggacctcccgggctggaccacgcctcccccaacccaacacactctctctaaatcgagcaccggtcgtgtatatactgtctgatggcgcgacgggaggcgatacg

SEQ ID NO: 790558 - DNA, 708 bp, Homo sapiens
  misc_feature: 14676.44.55.E11.1.pb.heavy.1.raw 14676
cgtatcgcctcctcggcgccatcagacagtatatacacgaccggtgctcgatttagcactcgcacgtttgggtttgggggaggagggagcccagcactgggattccgaggtgtttccattcgtgatcagcactgaacacagaggactcaccatggagttttggctgagctgggttctccttgttggacttttaaaaggtgtccagtgtgaggtgcggctgatggagtctggaggaggcttagtccagcctgggggggtcccagagactctcctgtgcagcctctgggctcacgtcagcagcaactacatgagttgggccgccaggctccagggaaggggctggagtgggtctcagtcatttatactggtgatttcacatactacgcagactccgtgaagggccgattcaccatctccagggacaattccaggaaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaaggggcccatcggtcttccccctggcaccctcctccaagagcacctctggggggcacagcggccctgggctggcctggtcaaggactacttcctatatactgtctgagcggctggcaaggcgcatag

SEQ ID NO: 790559 - DNA, 712 bp, Homo sapiens
  misc_feature: 14691.44.62.F07.1.pb.heavy.1.raw 14691
cgtatcgcctccctccgcgccatcagacagtatatacacgaccggtgctcgatttagtagtcgcataaagggaaagggagctctgagagaggagcccagccctgggattttcaggtgtcttcatttggtgaccaggaccgaacagagagaagtctccatggagtttgggctgagctgcctttttcttgtggcttttttaaaggggtgtcgtgtgtgaagtgcagttgttggagtctgggggggcctgattcggcctgggaggtccctgacccctctcctgtgcggcctctggattcacctttagtgctatggcatgacctgggtccgccgggctccagggaggggactggagtgggtctcaagtatcggagctggtggtgtcactttctacggagactccgtgaagggccgcttcaccatttccagggacaattcgcaggaacaaattgtttctccaaatgaaaaacctgagaccccgaggacacaggcgtctattactgttttgaaagccaggaccacggtgaccccccatgacacctttagtacttggggccgggggacagtggtgaccgtctcttcagcctccaccaagggcccatcggtcttccccctggcgcctgctccaggagcacctccgagagcacagcggcctgggctgcctggtcaaggactacttcctatatactgctgagcgggctggcaaggcgcatag

SEQ ID NO: 790560 - DNA, 724 bp, Homo sapiens
  misc_feature: 14695.44.36.D03.1.pb.heavy.1.raw 14695
gtatccgcctcccttcgccgccatcagacagtatatacacgaccggtgctcgatttagctgcgtcacgattctctcttggggggaggcggagcccccgagccccagaattcccaaggtgttttcatttggtgatcagcactgaacacagaggacttcaccatggagttcggtgcttgagctgggttttccttgttgttattttacaaggtggtccagagtgaagtgcagttggtggagtccggggggagacttggtccagcctggagggtccctgagactctcctgtgtcgcctctggattcaccatcagttgaccactatatggactggcgtcgccaggctccagggaaggggctggagtggctttggccgcagtaaaaacaaagttgccaggctttatcacagagttacgccgcgtctgtgaagagccagattccaccctctcaagagatgacttcaagaactcattgattctgcggaatgactaacctgaaaaccggaggacacgggcatgtatttattgtgttgtgtttatatcaggaactgtccactggggccagggaaccctggtcaccgtctcctcagccctccaccaagggccatcggtcttcccctgcgcgccctgctccaggagccacctccgagagcacagcgggccctgggctggcctggtcaagggactacttccctatatactgtcttgagcggctggcaaggcgcatag

SEQ ID NO: 790561 - DNA, 710 bp, Homo sapiens
  misc_feature: 14716.UNK.UNK.UNK.pb.heavy.1.raw 14716
cgtatcgcctccctcgcgccatcagaacagtatatacacgaccgtgctcgatttagctgcgtcacgatctctcttggggagctctgagagcggagcccccagccccagaattcccaggtgttttcattggtgatcagcactgaacacagaggactcaccatggagttcgggctgagctgggttttcctgttgttattttacaaggtgtccagagtgaagtgcagttggtggagtccgggggagacttggttccagcctggagggtccctgagactcctctgtgtcgcctctggattcaccatcagtgacactatatggaactggggtccgccaggctccagggaaggggctggagtgcttggccgcagtaaaaacaaagttgcagctttatcacaggagtacgcccgcgtctgtgaaagccagattcaccctctcaagagatgacttcaagaactcattgattctgcgaatgactaacctgaaaaacccgaggacacgggcatgtattattgtgttgtgtttatatcagggaactgtccactggggccagggaaccctggtcaccgtctcctcagcctccaccaagggcccatcggtcttccccctggcgccctgctccaggagcacctccgagagcacgcggccctgggctgcctggtcaaggaactactttcctatatactgtctgagcgggctggcaaggcgcatag

SEQ ID NO: 790562 - DNA, 717 bp, Homo sapiens
  misc_feature: 14733.44.85.H08.1.pb.heavy.1.raw 14733
ctatgcgccttgccagcccgctcagacagtatataggaagtagtccttgaccaggcagcccaggccgctgtgcccccagaggtgctcttggaggagggtgccaggggaagaccgatggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggccttcacggagtctgcatagtatttattacttccatcataccatataagtgccacccactccagccccttgcctggagcctggcggacccagtgcatgccataggtactgaaggtgaatccagacgctgcacaggagagtctcaggacctcccaggctggaccacgcctcccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggctcctctcccagagctcccgcgactgagtgatactaaatcgagcaccggtcgtgtatatactgtctgatggcgcgagggaggcgatacg

SEQ ID NO: 790563 - DNA, 713 bp, Homo sapiens
  misc_feature: 14765.44.56.F01.1.pb.heavy.1.raw 14765
cgtatcgcctccctcgcgccatcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagtttttttagaaggtgtccagtgcgagggcgactggcggaaagtcggggggggcttggcacagccagggcggtctctgagactctcctgtgtagtctcaggattcagtcttagtgattatcacttggcctgggtccgtcaggctccagggaagggcttgagtgggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttgggccaggggacaatggtcaccgtctcttcagcttccaccaagggcccatcggtcttccccctggcgccctgctccaggagcacctctgggggcacagcggccctgggctgcctggtcaaggactacttcctatatactgtctgagcgggctgcaaggcgcatag

SEQ ID NO: 790564 - DNA, 698 bp, Homo sapiens
  misc_feature: 14767.44.73.G07.1.pb.heavy.1.raw 14767
ctatgcgccttgccagccgctcagacagtatataggaagtagttccttgaccaggcaggcccagggccgctgtgctctcggaggtgctcctggagcagggcgccagggggaagaccgatgggcccttggtggaggctgaggagacggtgaccagggttccctggccccagtagtcaagcggggaccgtctcgagggggctctcgcacaataatagacagccgtgtcctcacttgtgaggttgtacatttgcagatgcagtgtgttcctggaattgtctctggagacggtgaatcggcccttctcggagtctccgtagtgttcttcaattccatcttctgatataattgcacccactccagccccttgcctggagcctggcggacccagtgcatggcataggtcctgaagatgaatccagaggctgcacaggagagtctcagggagttcccaggctgggccgctcctcccccagactccactagctgccacctgacactggcccacctcttaaaagaggcaacggaggaaaacccatctcagcccaaagtccatggtgagtcctctgtgttcagtgatgatcaccgaatggaaacaccggcgacttccagtgctgggctcgtctccccccctgagcgtagagctaaatcgagcaccggtcgtgtatatactgtctgatggcgcgaggggaggcgatacg

SEQ ID NO: 790565 - DNA, 607 bp, Homo sapiens
  misc_feature: 14770.UNK.UNK.UNK.pb.heavy.1.raw 14770
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacggccacgttgaattgtttattacctgtgactggctatggcttgcaacgccactcgtaaaactagtactttgcggttagggaagtagacaaacccattactccacttcccgaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 790566 - DNA, 644 bp, Homo sapiens
  misc_feature: 14835.44.86.H09.1.pb.heavy.1.raw 14835
ctatgcgccttgccagcccgctcagacagtatataggaagtagtccttgaccaggcagcccagggccgctgtgcccagaggtgctcctggagcagggcgccagggggaagaccgatgggcccttggtggaagctgaggagacagtgaccagggtgccacggccccatagatgaaagaccagtctcgcctcgcacagaaataaacggccgtgtccgcgcggtcacggaggtcagtttcagggagaagcggttcatggacgtgtccctcgaaatggtgagacgactctgagggacggagagtagtacgtcgcccagtataatggatgtcaccaatccactccattccctccctgggggctgccggatccagcccaagaatgatcagaactgatggaaactccagagacagtgcagatgagagacagggttcccgaaggcctcaccagtcctggcccgactcctgcagctgcacctgggacaggaccatctgggagctgccaccagcaggaggaaaaaccacaggtgcttatgttcttgcacaggagggtccttgactctcagaaagcatccccaaacccaagtctatagcactaaatcgagcaccggtcgtgtatatactgtctgatggcgcgaggaggcgatacg

SEQ ID NO: 790567 - DNA, 678 bp, Homo sapiens
  misc_feature: 14845.44.6.A06.1.pb.heavy.1.raw 14845
ctatgcgccttgccagccgctcagacagtatataggaagtagtccttgaccaggcagcccagggccgctgtgccccagaggtgctcctgggagcagggcgccaggggggaagaccgatgggcccttgtggaagctgaggtgacaatgaccagggttccctgcccccagatctcaaaggctccaatgcgagctgggggtacggacctctcgcacagtagtagacggccgtgtcgtcggatttcaaagaactcattgtcatggagacgtgtctgtgacttgtccgccggtaatcgtaattctgcccggaagtctcgtgcgtaggtgagtgagcaaaaagagggatgattccacccatccactcaagcccttgtccaggggcctggcgcaacccagttgatggtataagtagtggaactggtagtacttccagaggccgtgcaggaaaagggtcaccgaggaccaaggttgcggcatcctagtcccagactgcaccagttgcaccagggactggacacctgtttgctgctgccaccacaaagaggaacctccagtccagtccatggtgagatgagctgtgctccccaggggcttcttagaggaggaatgtggttgtcagtagatctaaatcgagcaccggtcgtggtatatactgtctgatggcgcgagggaggcgatacg

SEQ ID NO: 790568 - DNA, 707 bp, Homo sapiens
  misc_feature: 14865.44.27.C05.1.pb.heavy.1.raw 14865
ctatgcgcctttgccagcccgctcagacatatataggaagtagtccttgaccaggccagcccagggccgctgtgctctcggaggtgctcctggagcagggcgccaggggaagaccgatgggcccttggtggaggccgaggagacggtgaccagggttccctggccccaggcgtcgaatgaaccgatttttgggaaacagatagtctcgcacaaaaatacacggccgtgtcctgaggtctcaggctgtttcatttgaagagacactgtgttctcggaatgtctctggagatggtgaatcggccctcaacggaatcaccgtagacttgatttcctccatgaaatgacacacctgccaccactccagcccctcgcctggagcctggcggacccactgcatattccaattatcgaaggttgaatccagaggctgcacaggagagtctcagggacccccctactggggccacgcctccccagactccacgaattgcacctgacacatgacacctcttaagagggcaacgaggaaaaacccagctcagcccaaactccatggtgagtcctctgtgttcagtgatgatcaccgaagtggaaacaccggcgacttccagtgctgggctgtctcccaagccccaaacccttcgatcgcgtctaaatcgagcaccggtcgtgtatatactgtctgatggcgcgagggaggcgatacg

SEQ ID NO: 790569 - DNA, 699 bp, Homo sapiens
  misc_feature: 14904.44.55.E11.1.pb.heavy.1.raw 14904
cgtatcgcctccctcgcgccatcagacagtatatacacgaccggtgctcgatttagcactcgcacgttgggtttggggagaggagccagcactggattccgaggtgtttccattccggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcacctcctccaagagcacctctggggcacagcggccctggctgcctggtcaaggactacttcctatatactgtctgagcgggctggcaaggcgcatag

SEQ ID NO: 790570 - DNA, 728 bp, Homo sapiens
  misc_feature: 14931.44.33.C11.1.pb.heavy.1.raw 14931
ctatgcgccttgccagcccgctcagacagtatataggaagtagtccttgacaggcagcccagggccgctgtgcccccagaggtgctcttggaggagggtgccagggggaagaccgatgggcccttggtggaggctgaggagacggcgaccgtggtccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgcatgtctgttgaaagtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtggctgggctcctctcccagagctccccaaacccaacgagctcactctaaatcgagcaccggtcgtgtatatactgtctgatggcgcgagggaggcgatacg

SEQ ID NO: 790571 - DNA, 624 bp, Homo sapiens
  misc_feature: 14949.44.23.C01.1.pb.heavy.1.raw 14949
cgtatcgcctccctcgcgccatcagacagtatatacacgaccggtgctcgatttagtacacgtgattagggattgggcagggtgaacacctgtggtttttcctcctgctggtggcagctcccagatgggtcctgtccaggtgcagctgcagagtcgggcccaggactggtgaggccttcgggaaccctgtctctcatctgcactgtctctggagttttccatcagttctgatcattcttgggctggatccggccagcccccagggagggaatggagtggattggtgacatccattatactggggcgacgtactaactctccgtcctcaagaggtcgtctcaccgatttcgagggacacgtccatgaaccgcttctccctgaaactgacctccgtgaccgccgcggacacggccggtttatttctgtgcgaggcgcgagactggtctttcaatctatggggccgtgcaccctggtcactgtctcctcagcttccaccaagggcccatcggtcttccccctggcgccctgctccaggagcacctctggggcacagcggccctgggctgcgcctggttcaaggactacttcctatatactgtctgagcgggctggcaaggcgcatag

SEQ ID NO: 790572 - DNA, 709 bp, Homo sapiens
  misc_feature: 14990.UNK.UNK.UNK.pb.heavy.1.raw 14990
cgtatcgcctccctcgcgcgccatcagacagtatatacacgatcacgaccggtgctcgatttagtgttgagtagtttgggtttggggagctctgggagaggagccagccttggggattcccaggtgttttcattcagtgatcaggactgaacacagaggactcaccatggagtttgggctgagctggattttccttgctgctattttaaaggtgtccagtgtgaggtgcagttggtggagtctggggggaggtttggtaaagcctggggagtcccttagacgtctcctgtgcagcctctggattcactttttcagtaacgcctggatgacctgggtccggccaggctccagggaaggggctggagtgggttggccgtattagaaccaaagctgacgggtgggacagcagactacgctgcacccgtgaaaggcagattcaccatctcaagagatgattcaaaagatacggtgtctctgcagatgaacagcctgaacaccgaggacacagcccgtctattactgtctgggatggtttcattcgggccagggaaccctggtcaccgtctcctcagcctccaccaagggcccatcggtcttccccctggcgccctgctcccaggagcacctccgagagcacagcggccctgggctgcctggtcaaggactacttcctatatactctgtctgagcgggctggcaaggcgcatag

SEQ ID NO: 790573 - DNA, 532 bp, Homo sapiens
  misc_feature: 14991.UNK.UNK.UNK.pb.heavy.1.raw 14991
ctatgcgccttgccagcccgctcagacagtatataggaagtagtccttgaccaggcagcccaggccgctgtgccccagaggtgctcctgagcagggcgccaggggaagacgatggcccttggtggaagctgaggagacggtgaccagggttccctgccccagggtcgaacacctccccgacgagctgctatactttcggatctcgcacagtaatacacggccgtgtcctcagatctcaggctgctcagcccatgtaggctgtgtttatggaggtgttcctgtcatggtgactctgcctgaacttctgtgcatagcctgtgttacactgttagggttcatcatcccatccactcaagcccttgtccagtggcctgtcgcacccagttgatatcataattggtgaaggtgtatccagaagccttgcaggagaccttcactgaggccccaggcttcttcactcagccccttactgctagtctaaatcgagcacggtcgtgtatatactgtctgatggcgcgagggaggcgatacg

SEQ ID NO: 790574 - DNA, 692 bp, Homo sapiens
  misc_feature: 15018.44.55.E11.1.pb.heavy.1.raw 15018
cgtatcgcctccctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccagggaagggctggagtgggtctcagtcatttatactggtgatttcacatactacgcagactccgtgaaggccgattcaccatctccagggacaattccaggaacacggttatcttcaaatgaacaacctgagaggcgacgacacggccgtctattactgtgcgagacaagtcgcgctcggagtggttatattcgtttgactctgggccagggaaccctggtcaccgtcgcctccgcctccaccaagggcccatcggtcttccccctggcaccctcctccaagagcacctctggggcacagcggccctgggctgcctggtcaaggactacttcctatatactgtctgagcggctgcaaggcgcatag

SEQ ID NO: 790575 - DNA, 722 bp, Homo sapiens
  misc_feature: 15030.44.86.H09.1.pb.heavy.1.raw 15030
cgtatcgcctcctcgcgccatcagacagtatatacacgaccggtgctcgatttagtgctatagacttgggttggggagctctggggagaggagccccagcaccagaagtcggcggtgtttcagtcggtgatcagcaccgaacacagaggactcaccatggagtttgggctgacctgggttttcctcgttgctcttttaagaggtgtccagtgtcaggtgaagctgtggagtctgaggggcgtggtccagcctgggagtccctgagactctctgtgtagcgtctggatcaccttcaaccagacatggcatgcactgggtccgccaggctccaggcaagggactggagtgggtggcacttggtatggtatgatggaagtaataaatattatgtagattccgtgaagggccgttcaccatctccagagacaattcgaagaacacactatatctggaaatgaatagcctgagagccgaggacacggctggtctctactctgtgcgagagatggggctcgtggatacagatatgacatgctctactccaatggtatggacgcctggggccaagggaccacggtcgccgtctcctcagcctccaccaagggcccatcggtcttccccctggcaccctcctccaaggcacctctgggggcacagcggccctgggctgcctggtcaagactacttcctatatactgtctgagcgggctgcaaggcgcatg

SEQ ID NO: 790576 - DNA, 688 bp, Homo sapiens
  misc_feature: 15044.44.73.G07.1.pb.heavy.1.raw 15044
cgtatcgcctccctcgcgccatcagacagtatatacacgaccggtgctcgatttagctctacgctcagggggggaagacgagccagcactggaagtcgccggtgtttccattcggtgatcatcactgaacacagaggactcaccatggactttgggctgagatgggttttcctcgttgctcttttaagaggtggccagtgtcaggtgcagctgtgagtctgggggaggagcggcccagcctggaactccctgagactctcctgtgcagcctctggattcatcttcaggacctatgcatgcactggtccgcccaggctccaggcaaggggctggagtgggtggcaattatatcaagaagatggaattgaagaacactacggagactccgagaagggccgattcaccgtctccagagacaattccaggaacacactgcatctgcaatgtacaacctcacaagtgaggacacggctgtctattattgtgcgagagcccctcgagacggtccccgcttgactactggggccagggaaccctggtcaccgtctcctcagcctccaccaagggcccatcggtcttcccccctggcgccctgctccaggagcacctccgagagcacagcggccctggctgcctggtcaaggactacttcctatatactgtctgagcgggctggcaaggcgcatag

SEQ ID NO: 790577 - DNA, 606 bp, Homo sapiens
  misc_feature: 15050.UNK.UNK.UNK.pb.heavy.1.raw 15050
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 790578 - DNA, 699 bp, Homo sapiens
  misc_feature: 15076.44.55.E11.1.pb.heavy.1.raw 15076
cgtatcgcctccctcgcgccatcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgagtgcggctgatggagtctggaggaggcttagtccagcctgggggtcccagagactctcctgtgcagcctctgggctcaccgtcagccagcaactacatgagttgggtccgccaggctccagggaagggctggagtgggtctcagtcatttatactggtgatttcacatactacgcagactccgtgaagggccgattcaccatctccaggacaattccaggaacacggtttatcttcaaatgaacaacctgagaggcgacgacacggccgtctattactgtgcgagacaagtcggcgctcggagtggttattattcgtttgacttctggggcaggaaccctggtcaccgtcgcctccgcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 790579 - DNA, 601 bp, Homo sapiens
  misc_feature: 15096.UNK.UNK.UNK.pb.heavy.1.raw 15096
cccgacacgcttgctagggactggagctaaggacgacatattgcctttagacagtcgaaggtgacgccttagctaccactgaacgtttaggcgccagatgcggtctggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacataggcctgcttggggtgttgagtttacttttatttcgtgttggaatgagttgaacttccggaagtggagtaatgggtttgtctacttccctaaccgcaaagtactagttttacgagtggcgttgcaagccatagccagtcacaggtaataaacaattcaacgtggcgtaaagattgccgcttgctgtgggcattgcaagctgggttgcagcattgtgcatgctagacgacaatatgaatctgcggaccctagtggccaagatggccgctagcgggttccgcagcttttgacctggaccagggtgcatagcctgcccagccttc

SEQ ID NO: 790580 - DNA, 694 bp, Homo sapiens
  misc_feature: 15097.UNK.UNK.UNK.pb.heavy.1.raw 15097
ctatgcgccttgccagcccgctcagacagtatataggaagtagtccttgaccaggcagccaggccgctgtgctctcgaggtgctcctggagcagggcgccaggggaagacgatggcccttggtgaggctgaagagacggtcaccactgtccccccgccccaagtactaaaggtgtcatggggggtcacgtggtcctggctttcaaacagtaatagacgcctgtgtcctcgggtctcaggtttttcatttggagaaacaatttgtcctgcgaattgtccctggaaatggtgaagcggcccttcacggagtctccgtagaaagtgacaccacagctccgatacttgagacccactccagtccctccctggagccggcggacccaggtcatgccataggcactaaaggtgaatccagaggccgcacaggagaggggtcagggacctccaggccgaatcaggcccccccagactccaacaactgcacttcacaccgacaccctttaaaaagccacagaaaaaggcagctcagcccaaactccatggagacttctctctgttcggtcctggtcaccaaatgaagacacctgaaaatcccagggctgggctcctctctcagagctccctttccctttatgcgactactaaatcgagcacggtcgtgtatatacgtctgatggcgcgagggaggcgatacg

SEQ ID NO: 790581 - DNA, 609 bp, Homo sapiens
  misc_feature: 15144.UNK.UNK.UNK.pb.heavy.1.raw 15144
cccgaccacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaaatagaatccacccctatcaccccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggaccctagtggccaagatggccgctagcggttccgcagcttttgacctggaccagggtgcatagcctgcccagccttc

SEQ ID NO: 790582 - DNA, 670 bp, Homo sapiens
  misc_feature: 15158.44.12.B01.1.pb.heavy.1.raw 15158
ctatgcgccttgccagccccgctcagacagtatataggaagtagtccttgaccaggcagcccagggccgctgtgccccccagaggtgctcttggaggagggtgccaggggaagaccgatgggcccttggtggaggctgaggagacggtgaccagggttccctggccccagtggtcaaagtagttggtgacgaactgccctactctcgcacagtaatacacggcccgtgtccgcggcggtcacagagctcagcttcagggagaactggttcttggacgtgtctactgatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaagggcttcaccagtcctgggcccgactcctgcagctgcagctgggacaggacccatctgggagccgccaccagcaggaggaagaaccacaggtgcttcatgttcttgcacaggaggtccatgactctcagaaaagcccccgcggaatctacactactaaatcgagcaccggtcgtgtatatactggtctgatggcgcgagggaggcgatacg

SEQ ID NO: 790583 - DNA, 699 bp, Homo sapiens
  misc_feature: 15185.44.55.E11.1.pb.heavy.1.raw 15185
cgtatcgcctccctcgcgccatcagacagtatatacacgaccggtgctcgatttagcactcgcacgttggtttgggggggagaggagcccagcactgggattccgaggtgtttccattcgtgatcagcactgaacacagaggactcaccatggagttttggctgagctgggttctccttgttggacttttaaaaggtgtcagtgtgaggtgcggctgatggagtctggaggaggcttagtccagcctggggggtcccagagactctcctgtgcagcctctgggctcaccgtcagcagcaactacatgagttgggtccgccaggctccagggaagggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttcccctggcaccctcctccaagagcacctctgggggcacagcggcctggctgcctggtcaaggactacttcctatatactgtctaagcgggctggcaaggcgcatag

SEQ ID NO: 790584 - DNA, 672 bp, Homo sapiens
  misc_feature: 15194.UNK.UNK.UNK.pb.heavy.1.raw 15194
ctatgcgccttgccagcccgctcagacagtatattaggaagtagtccttgaccaggccaggcccagggccgctgtgcccccagaggtgcctcctggagccagggcgccaggggggaagaccgatgggccctttggtggaagctgaggagacagtggacccagggtgccacggccccatagaattgaaagaccagtctcgcctcgcacagaaataaacggccgtgtccgcggccggtcacggaggtcagtttcagggagaagcggttcatggacgtgtccctcgaaatggtgagacgactcttgagggacggagagtagtacgtcggccccagtataatggatgttcaccaatccaactccattcccctcccttgggggcttgccggatccagcccaagaatgatcagaactgatggaaactccagagacagtgcagatgaagagacagggttcccgaaggcctcaccagtcctgggcccgactcctgcaggctgcacctgggacagggacccatctgggagctgccaccagcaggaggaaaaaccacaggtgccttcatgttcttgcacaggaggtccttgactctcagaaaggccccaatccctaatcacgtgtactaaatcgagcacgggtcgtgtatatactgtctgatggcgcgagggaggcgatacg

SEQ ID NO: 790585 - DNA, 729 bp, Homo sapiens
  misc_feature: 15200.UNK.UNK.UNK.pb.heavy.1.raw 15200
cgtattcgcctccctcgcggccatcagacagtatatacacgactccacgacggtgctcgatttagccactcgcacgttgggttgggagaggagagccagcactgggattccagtgtttccattcggtgatcgcaccacactgaacacagaggactcaccatgggagttttgcctgagctgggttctccttgttggacttttaaaaggtgtccagtgtgaggtgcggctgatggaagtctggagaggcttagtccagcctgggggtcccagagactcttcctgtgcaggcctctgggctcaccgtcagcaagcaactacatgagttgggtcccccgcaggctccagggaaggggctggagtggggtctcagtcatttatactggtgatttcacatactacgcagactccgtgaagggccgatttcacgcatctccagggagcaattccaggacacccgccggtttatcttcaaatgaaacaacctgagaggcgacgacacgggccgtctattactgtgcgagacaagtcggcgctcggagtggttattattcgtttgacttctggggccagggaaccctggtcaccgtcgcctccgcctccaccaagggcccatcggtcttcgcctggcaccctcctccaagagcacctctgggggcacagcggccctgggctgcctggtcaaggactacctgcctatatactgtctgagcgggctggcaaggcgcatag

SEQ ID NO: 790586 - DNA, 749 bp, Homo sapiens
  misc_feature: 15201.UNK.UNK.UNK.pb.heavy.1.raw 15201
ctattgcgccttgccagcccgctcagacagtatataggaagtagtccttgaccaggcagcccagggccgctgtgctctcggaggtgctcctggagcagggcgccaggggaaggaccgatgggcccttggtggaggctgaaggagacggtgaccagggttccctggcccccagtggacagttcctgatataaacacaacacaataataccatgcccgtgtcctcgggttttcaggttagtcattcgcagaatcaatgagtattcttgaagtcatctcttgagagggtgaatctggctttcacagaacgcggcgtactctgtgataaaggctggggataatactactttgtttttactgccgtgcccaaggccactccagccctcttccctggagcctgggcggacccagatccatatagtggtccactgatggtgaatccagaaggcgacacaggaggagtctcagggaccctccaggctggaccaagtctcccccggactcaccaactgcacttcactctggacaccttgtaaaataacaacaaggaaaaacccagctcagccccgaactccatggtgagtcctctgtgttcagtgctgaatcaccaaaatgaaaaacacctgggaatttctggggctggggctcccgctctcagagctccccaagagagatcgtgacgcagctaaatcgagcaccggttcgtgtatatactgttctgatggcgcgagggctgaaagaggcgatacggg

SEQ ID NO: 790587 - DNA, 655 bp, Homo sapiens
  misc_feature: 15207.44.23.C01.1.pb.heavy.1.raw 15207
ctatgcgccttgccagccgctcagacagtatataggaagtagtccttgaccaggcagcccagggccgctgtgcccccagaggtgctcctggagcagggcgccagggggaagaccgatgggccctttggtggaagctgaggagacagtgaccagggtgccacggccccatagattgaaagaccagtctcgcctcgcacagaaataaacggccgtgtccgccggcggtcacggaggtcagtttcagggagaaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcccccaatccctaatcacgtgtactaaatcgagcaccggtcgtgtatatactgtctgatggcgcgagggaggcgatacg

SEQ ID NO: 790588 - DNA, 726 bp, Homo sapiens
  misc_feature: 15208.UNK.UNK.UNK.pb.heavy.1.raw 15208
cgtatcgcctccctcgcgccatcagacagtatatacaccgaccggtgctcgatttagctgcggtcacgatctctcttggggagctctgagagcggagccccagccccagaattcccaggtgttttcatttggtgatcagcactgaaacacagaggactcaccatggagttcggggctgagctgggttttccttgttgttattttacaaggtgtccagagtgaagtgcagttggtggagtccgggggagacttggtccagcctggagggttccctgagactctcctgtgtcgcctctggattcaccatcagtgacccactatatggactggggtccgccaggccctccagggaagggggctggagtggcttggccgcagtaaaaacaaagttggcagctttatcacagagtacgccgcgtctgtgaaagccagattcaccctctcaagagatgactttcaagaactcattgattctgcgaatgactaacctgaaaccggaggacacgggccatgtatctattgtgttgtgtttatatcaggaactgtccactggggccagggaaccctggtcaccgtctcctccagcctccaccaagggccccatcggttcttccccctggcgccctgctccaggagcacctccgagagcacagcggccctgggctgcctggtcaaggactactttccttctatatactgtctgagcggctggcaaggcgcccatag

SEQ ID NO: 790589 - DNA, 688 bp, Homo sapiens
  misc_feature: 15218.44.6.A06.1.pb.heavy.1.raw 15218
ctatgcgccttgccagcccgctcagacagtatataggaagttagtccttgaccaggcagcccagggccgctgtgcccccagaggtgctcctggagcagggcgccagggggaagaccgatgggcccttggtggaagctgaggtgacaatgaccagggttccctgcccccagatctcaaaggctccatgcgagctggggtacgggaccttctcgcacagtagtagacggcccgtgtcgtcggatttcaaagaactcattgtcatggagactgtgtctgtggacttgtccgccggtaatcgtaattctgcccggaagtctcgtgcgtaggtgagtgagccaaaaaagagggatgattccacccatccactcaagcccctttgtccaggggcctggcgcagccagttgatggtataagtagtggaactggtagtacttccagaggccgtggcaggaaaagggtcaccgaggaccaggttgcggcattctagtcccagactgcaccagttgcaccaggggactggacacctgttgctgctgccaccacaaggaggaacctccaggtccagtccatggtgatgagctgtgctccccaggggccttctttagaggaggaatggtgtgttgtcagtagatctaaatcgagcaccggtcgtgtatatactgtctgatggcgcgagggaggcgatacg

SEQ ID NO: 790590 - DNA, 700 bp, Homo sapiens
  misc_feature: 15221.44.36.D03.1.pb.heavy.1.raw 15221
cgtatcgcctccctcgcgccatcagacagtatatacacgaccggtgctcgatttagctgcgtcacgatctctcttgggggagagcggagcccagccccagaattcccaggtgtttttcatttggtgatcagcactgaacacagaggactcaccatggagttcgggctgagctgggttttccttgttgttattttacaaggtgtccagagtgaagtgcagttggtggagtccggggagacttggtccagcctggagggtcctgagactctcctgtgtcgcctcctggattcaccatcagtgaccactaatggactcggggtccgccaggctcagggaaggggctggagtgcttggccgcagtaaaaacaaaagttgccagctttatcacagagtacgccgcgtctgtgtgaaagccagattcaccctctcaagagatgacttcaagaactcattgattctgcgaatgactaacctgaaaaaccgaggacacgggcatgttattattgtgttgtgtttatatcaggactgtccactgggggccagggaaccctggtcaccgtctcctcagccgtccaccaagggcccatcggtcttccccctggcgccctgctccagagcacctccgagagcacagcgccctgggctgcctggtcaagactacttcctatatactgtctgagcgggctggcaaggcgcatag

SEQ ID NO: 790591 - DNA, 683 bp, Homo sapiens
  misc_feature: 15230.UNK.UNK.UNK.pb.heavy.1.raw 15230
cgtatcgctccctcgcgccatcagacagctatataccgaccggtgctcgatttagtgagtcagtaagggaaaggggctgggagaggagcccagcactagaagtcggcggtgttccattcggtgatcagcactgaacacagaggactcaccatggagttttgggctgagctgcggttttcctcgttgctcttttaagaggtgtccagtgtcaggttcagctggtggagtctggggaggcgtggtccagcctgggagcgtccctgagactctcctgtgttgcgtccggactcagtttcagtgactctgccatgcactgggtccgccaggctccaggccaaggggctggagtggcgtggcagtcatctggtctgatggaagtaaagaatactatggaaactccgtgaagggccgattctcgcgtctccagagacaattccaagaacaccgtgtatctacaaatgacaattgagagccgaggactcggctctcttattattgtacgagcccatcgttctactggggccagggagccctggtcaccgtctccctcagcctccaccaagggccatcggtcttcccctggcgcctgctccaggagcacctccgagagcacagtggccctgggctgcctggtcaaggactaacttcctatatactgtctgagcggctggcaaggcgcatag

SEQ ID NO: 790592 - DNA, 608 bp, Homo sapiens
  misc_feature: 15237.UNK.UNK.UNK.pb.heavy.1.raw 15237
cccgacacgcttgctagggacttggagctaaggacgacatattgcctttagacagtcgaaggtgacgccttagctaccactgaacgtttagggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcaccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 790593 - DNA, 650 bp, Homo sapiens
  misc_feature: 15247.44.6.A06.1.pb.heavy.1.raw 15247
tgcgcttgccagccgctcagacagtatataggaatagtccttgaccaagcagcccaggccgctgtgccccagagtgctcctggagcagggcgccaggggagacgatggccttgtggaagctgaggtgacaatgaccagggttccctgccccagatctcaaaggctccatgcgagctggggtacggacctctcgcacagtagtagacggccgtgtcgtcggatttcaagaactcattgtcatggagactgtgtctgtgacttgtccgcggtaatcgtaattctgccccggaagtctcgtgcgtaggtgagtgagccaaaaagagggatgattccacccatccactcaagccttgtccgggcctggcgcacccagttgatggtataagtagtggaactggtagtacttcagaggccgtgcaggaaaggtcaccgaggaccaaggttgcggcattctagtccagactgcacagtttgcaccagggactgggacacctgttgctgctgccaccacaaagagaacctccaggtccagtccatggtgatgagctgtgctcccaggcttctttagaggaggaatgtggttgtcagtagatctaaatcgagcaccggtcgtgttatatactgtctgatggcgcgagggaggcgatacg

SEQ ID NO: 790594 - DNA, 625 bp, Homo sapiens
  misc_feature: 15248.UNK.UNK.UNK.pb.heavy.1.raw 15248
cgtatcgcctccctcgcgccatcagacagtatatacacgacggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggaccacggccgtttattttctgtgcgaggcgagactgggtctttcaatctatggggccgtggcaccctggtcactgtctcctcagcttccaccaagggcccatcggtcttccccctggcgccctgctccaggagcacctctggggcacagcggccctgggctgcctggtcaaggactacttttcctatatactgtctgagcgggctggcaaggcgcatag

SEQ ID NO: 790595 - DNA, 701 bp, Homo sapiens
  misc_feature: 15263.44.36.D03.1.pb.heavy.1.raw 15263
ctatcgcccttgccagcgccctcagacagtatatagaagtagtccttgaccagcagcccaggccgctggtgctcggaggtggctcctggagcagggcgccagggggaagaccgatggcccttggtggaggctgaggagacggtaccagggttccctggccccagtggacagttcctgatataaacacaacacaataatacatgccccgtgtcctcggtttcggttagtcatcgcagaatcaatgagttctgaagtcatctcttgagagggtgaatctggctttcacagacgcggcgtaactctggataaagctctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctgggacacctttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 790596 - DNA, 587 bp, Homo sapiens
  misc_feature: 15285.44.78.H01.1.pb.heavy.1.raw 15285
cgtatcgcctccctcgcgccatcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatggatggatgaagccctatagtggcaacacgggctttgccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttcccctggcgccctgctccaggagcacctcgagagcacagcggccctgggctgcctggtcaaggactacttcctatatactgtctgagcgggctggcaaggcgcatag

SEQ ID NO: 790597 - DNA, 608 bp, Homo sapiens
  misc_feature: 15302.UNK.UNK.UNK.pb.heavy.1.raw 15302
ccgacacgcttgctaggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccagggtcttgatgcgcgcgataggactgacgggatcgctacagaacatttaactcgctagtacttaattgagatcctaggggatgggataggaaatagaatccaccctatcaccccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgccagcattgtgcatgctagacgacaatatgaatctgcgggacccctagtggccaagatggccgctagcgggttccgcagcttttgacctggaccagggtgcatagcctgcccagccttc

SEQ ID NO: 790598 - DNA, 699 bp, Homo sapiens
  misc_feature: 15312.UNK.UNK.UNK.pb.heavy.1.raw 15312
cgtatcgcctccctcgcgccatcagacagtatatacacgacggtgctcgatttagctgcgtcacgatctctcttgggggagagcggagccccagccccagaattcccaggtgttttcatttggtgatcagcactgaacacagaggactcaccatggagttcgggctgagctgggtttttccttgttgttattttacaaggtgtccagagtgaagtgcagttggtggagtccgggggagacttggtccagcctggagggtccctgagactctcctgtgtcgcctctggattcaccatcagtgaccactatatggactggggtccgccaggctccagggaagggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctggctgcctggtcaaggaactacttcctatatactgtctgagcgggctggcaaggcgcatag

SEQ ID NO: 790599 - DNA, 703 bp, Homo sapiens
  misc_feature: 15314.44.36.D03.1.pb.heavy.1.raw 15314
cgtatcgcctccctcgcgccatcagacagtatatacacgaccggtgctcgatttagctgcgtcacgatctctcttggggagctctgagagcggagccccagccccagaattcccaggtgtttttcatttggtgatcagcactgaacacagaggactcaccatggagttcgggctgagctgggttttccttgttgttattttacaaggtgtccagagtgaagtgcagttggtggagtccgggggagacttggtccagcctggagggtcctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaaagaactcattgattctgcgaatgactaacctgaaaacgaggacacgggcatgtattattgtgttgtgtttatatcaggaactgtccactggggccagggaaccctgtcaccgtctcctcagcctccaccaagggcccatcggtcttccccctggcgccctgctccaggagcacctccgagagcacagcggccctggctgcctggtcaaggactacttcctatatactgtctgagcgggctggcaaggcgcatag

SEQ ID NO: 790600 - DNA, 671 bp, Homo sapiens
  misc_feature: 15325.44.53.E09.1.pb.heavy.1.raw 15325
cgtatcgcctccctcgcgccatcagacagtatatacacgaccggtgctcgatttagagagagtgtgttgagctctggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtctggggaggttggtaaagcctggggagtccttagactctcctgtgcagctctggattcacttcagtaacgcctggatgacctgggtccgccaggctccagggaagggctggagtgggttggccgtattagaaccaaagctgacggtggacagcagactacgctgcacccgtgaaaggcagattcaccatctcaagagatgattcaaaagatacgtgtctctgcagatgaacagcctgaacaccgaggacacagccgtctattactgtctgggatgtttcattcgggccagggaaccctggtcaccgtctcctcagcctcacaagggcccatcggtcttccccctggcgcccctgctccaggagcacctcgagagcacagcgggccctgggctgcctggtcaaggactacttcctatatactgtctgagcggctggcaaagcgcatag

SEQ ID NO: 790601 - DNA, 718 bp, Homo sapiens
  misc_feature: 15332.UNK.UNK.UNK.pb.heavy.1.raw 15332
ctatgcgccttgccgcccgctcagacagtatataggaagtagtccttgaccaggcagcccagggccgctgtgcccccagaggtgctcttggaggagggtgccaggggggaagaccgatgggcccttgtggaggcggaggcgacggtgaccaggggttccctggccccatgaagtcaaacgaataataaccactccgaggccgacttgtctcgcacagtaatagacggccgtgtcgtcgcctctcaggttgttcatttgaagataaaccggtgttcctggaattgtcccctggagatggtgaatcggcccttcacggagtctgcgtagtatgtgaaatcaccagtataaatgactgagacccactccaagcgcccttccctggaagcctggcggacccaaactcatgtagttgctgctgacggtgagcccagaggctgcacaggagagtctctgggacccccccagctgctggactaagcctcctccagactccatcagccggcaccgtcacagctggacacctttaaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgctaatcgagcaccgcgtcgtgtataatactgtctgatggcgcgagggaggcgatacg

SEQ ID NO: 790602 - DNA, 610 bp, Homo sapiens
  misc_feature: 15337.44.27.C05.1.pb.heavy.1.raw 15337
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcattgaagagacactgtgttctcggaattgtctctggagatggtgatcggccctcaacggaatcaccgtagacttgattcctccatgaaatgacacacctgccacccactccagcccctcgcctggagcctggtggacccactgcatattccaattatcgaaggtgaatccagagctgcacaggagagtctcagggacccccctactggggccacgcctccccagactccacgaattgcacctgacacatgacacctcttaagaggcaacgaggaaaacccagctcagcccaaacccttcgatcgcgtctaaatcgagcaccggtcgtgtatatactgtctgatggccgcgagggagcgatacg

SEQ ID NO: 790603 - DNA, 612 bp, Homo sapiens
  misc_feature: 15338.44.23.C01.1.pb.heavy.1.raw 15338
cgtatcgcctcctcgcgccatcagacagtatatacacgaccggtgctcgatttagtacacgtgattagggattgggcagggtgaacacctgtggtttttcctcctgctggtggcagctcccagatgggtcctgtcccaggtgcagctgcaggagtcgggcccaggactggtgaggccttcgggaacctgtctctcatctgcactgtctctggagtttccatcagttctgatcattcttgggctggatccggcagcccccaggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggcgtttatttctgtgcgaggcgagactggtctttcaatctatggggccgtggcaccctggtcactgtctcctcagcttcaccaagggcccatcggtcttcccctggcgccctgctccaggagcacctctgggggcacagcgccctgggctgcctggtcaaggactacttcctatatactgtctgagcgggctggcaaggcgcatag

SEQ ID NO: 790604 - DNA, 671 bp, Homo sapiens
  misc_feature: 15342.UNK.UNK.UNK.pb.heavy.1.raw 15342
ctatgcgccttgccagcccgctcagacagtatataggaagtagtccttgaccaggcagcccagggccgctgtgccccagaggtgctcctggagcagggcgccaggggaagaccgatgggcccttggtggaagcgaggtgacaatgaccagggttccctgcccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaaagagggatgattccacccatccactcaagcccttgtccaggggcctggcgcacccagttgatgggtataagtagtggaactggtagtacttccagaggccggcaggaaagggtcaccgaggaccaaaggttgcggcattctagtcccagactgcaccagttgcaccaggactgacacctgttgctgctgccaccacaaagagaacctccaggtccagtccatggtgatgagctgtgctcccaggggcttctttagaggaggaatgtggttgtcagtagatctaaatcgagcaccggttcgtgtatatactgtctgatggcgcgagggaggcgatacg

SEQ ID NO: 790605 - DNA, 660 bp, Homo sapiens
  misc_feature: 15348.44.57.F02.1.pb.heavy.1.raw 15348
cgtatcgcctccctcgcgccatcagtctatactatcacgaccggtgctcgatttagctcgatatagttgggttttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggcccttcgggaaccctgtctctcatctgcactgtctctggagtttccatcagttctgatcattctttgggggctggatccggcagcccccagggaggggaatggagtggattggtgacatccattatactggggggcgacgtactactctccgtccctcaagagtcgtctcaccatttcgagggacacgtccatgaaccgcttctccctgaaactgacctccgtgaccgcccgcggacacggccgtttattttctgtgcgaggcgagactggtctttcaatctatggggccgtggcaccctggtcactgtctcctcagcttccaccaaggcccatcggtcttccccctggcgccctgctccaggagcacctctgggggcacagcggccctgggctggcctggtcaaggactattcctatatactgtctgagcgggctggcaaggcgcata

SEQ ID NO: 790606 - DNA, 593 bp, Homo sapiens
  misc_feature: 15365.44.78.H01.1.pb.heavy.1.raw 15365
cgtatcgcctccctcgcgccatcagaccagtatatacacgaccggtgctcgatttagtgtgagtagttttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790607 - DNA, 698 bp, Homo sapiens
  misc_feature: 15376.44.36.D03.1.pb.heavy.1.raw 15376
ctatgcgccttgccagcccgctcagacagtattataggaagtagtccttgaccaggcagcccaggccgctgtgctctcggaggtgctcctggagcaggcgccagggggaagaccgatgggcccttggtggaggctgaggagacggtgaccagggttccctggcccagtggacagttcctgatataaacacaacacaataatacatgcccgtgtcctccgttttcaggttagtcattcgcagaatcaatgagttcttgaagtcatctcttgagaggtgaatctggcttcacagacgcggcgtactctgtgataaaggctggcactttgtttttactggcggccaagccactcagccccttccctggagcctggcggacccagtccatatatagtggtcactgatggtgaatcagaggcgacacaggagagtctcaggacccctccaggctggaccaagtctccccccggactccaccaactgcacttcactctgacaccttgtaaaataacaacaaggaaaacccagctcagcccgaactccatggtgagtctctgtgttcagtgctgatcaccaatgaaaacacctgggaattctgggctgggggctccgctctcagagctcccaagagagatcgtgacgcagctaaatcgagcaccggtcgtgtatatactgtctgatggcgcgaggaggcgatacg

SEQ ID NO: 790608 - DNA, 692 bp, Homo sapiens
  misc_feature: 15378.UNK.UNK.UNK.pb.heavy.1.raw 15378
cgtatcgcctccctcgcgccatcagacagtatatacacgaccgtgctcgatttagacgcgatcgaagggtttggggctgggagacgagcccagcactggaagtcgccggtgtttcactcggtgatcatcactgaacacagaggactcaccatggagtttgggctgagctgggttttcctcgttgccctctaagaggtgtcatgtgtcaggtgcaattcgtggagtctggggaggcgtggcccagtaggggggtcctgagactctcctgtgcagctctggattcaccttcgataattggaatatgcagtggtccgccaggctccaggcgagggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccaggaaccctggtcaccgtctcctcggcctccaccaagggcccatcggtcttcccctgcgccctgctccaggagcacctccgagagcacagcggccctgggctgcctggtcaaggactacttcctatatactgtctgagcgggctggcaaggcgcatag

SEQ ID NO: 790609 - DNA, 650 bp, Homo sapiens
  misc_feature: 15403.UNK.UNK.UNK.pb.heavy.1.raw 15403
ctatgcgccttgccagccccgctcagacagtatataggaagtagtccttgaccaggcagccagggcgctgtgcccccagaggtgctcttggaggagggtgccaggggaagacgatgggccccttggtggaggctgaggagacggtgacccagggttccctggccagtggtcaagtagttggtgacgaacgccctactctcgcacagtaatacaccggcgtgtcgcggcgggtcacagagctcagcttcaggagaactggttcttgacgtgtctactgatatgggtgactcgactcttgagggaccggttgtagtaggtgctcccactataataggatactccaatccactccagcccttccctgggggctgcggatcagcccagtagtaactactactgctgatggagcaccagagacagtgcaggtgagggacagggtctcgaaggcttcaccagtcctgggccgactcctgcagctgcagctgggacaggaccatctgggagccgccaccagcaggagaagaacacaggtgcttcatgttcttgcacaggaggtccatgactctcagaagccccgcggaatctacactactaaatcggagccaccggtccgtgtatatactgtctgatggcgcgaggagggcgatacg

SEQ ID NO: 790610 - DNA, 710 bp, Homo sapiens
  misc_feature: 15461.UNK.UNK.UNK.pb.heavy.1.raw 15461
tcgtatcgcctccctcgcgccatcagacagtatataacacgaccggtgctccgatttagcgagacgcgcagggggggagacgagcccagcactggaagtcgccggtgtttttccattcggtgatcatcactgaacacagaggactcaccatgggactttgggctgagatggttttttcctccgttgctcttttagaggtggcccagtgtcaggtgcagctagtggagtctgggggaggagcggcccagcctgggaactccctgagactctcctgtgcagcctctggaaattcatctttcaggacctatgccatgcactgggttccgccaggctccaggcaaggggctggagtgggtggcaattatatcagaagatggaattgaagaaacactacggagactccgagaaggggccgattcaccgtctccagagacaattccaggaacacactgcatctgcaaaatgtacaacctcacagtgaggacacggctgtctattattgtgcgagagccccctcgagacggtcccccgcttgactactggggccagggaaaccctggtcaccgtctcctcagcctccaccaagggcccatcggtcttccccctggcgcccctgctccaggagcaccctccgagagcacagcggccctggctgcctggtcaaggactacttcctatatactgtctgagcgggctggcaaggcgcatag

SEQ ID NO: 790611 - DNA, 653 bp, Homo sapiens
  misc_feature: 15488.44.86.H09.1.pb.heavy.1.raw 15488
ctatgcgccttgccagcccgctcagacagtatataggaagtagtccttgaccaggcagcccagggccgctgtgcccccagaggtgctcctggagcagggcgccaggggaagaccgatgggcccttggtgaagctgaggagacagtgaccagggtgccacggccccatagattgaaagaccagtctcgcctcgcacagaaataaacggcccgtgtccgcggcggttcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctggcccgactcctgcagctgcacctgggacaggacccatctggggagctgccaccagcaggagaaaaaccacaggtgcttcatgttcttgcacaggaggtccttgactctcagaaagcatccccaaaccaagtctatagcactaaatcgagcaccggtcgtgtatatactgtctgatggcgcgagggaggcgatacg

SEQ ID NO: 790612 - DNA, 698 bp, Homo sapiens
  misc_feature: 15526.44.36.D03.1.pb.heavy.1.raw 15526
cgtatcgcctccctcgcgccatcagacagtatatacacgaccggtgctcgatttagctgcgtcacgatctctcttggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggctggccgcagtaaaaacaaagttgccagctttatcacagagtacggccgcgtctgtgaaagccagattcaccctctcaagagatgacttcaagaactcattgattctgcgaatgactaacctgaaaaaccgaggacacgggcatgtattattgtgttgtgtttatatcaggaactgtccactggggccagggaaccctgtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790613 - DNA, 553 bp, Homo sapiens
  misc_feature: 15529.44.26.C04.1.pb.heavy.1.raw 15529
cgtatcgcctccctcgcgccatcagacagtatatacacgaccggtgctcgatttagtctagcgactttgggtttggggacgcctagttcggccgggggggcccctaagactctcctgtctcgtctctgaacccacctttagcagctactggatgcactgggtccgccaagctccaggaaagggcctgatgtgggtctcacgtattaacaccgatgggactatcactggttactcagacgccgtgaagggccgattcatcatctccagagacaatgtcgaaaacacggtgtatttacaaatgaacagtctaagagtcgaggacacggctgtctactattgtgtgagaccttatgatttcacttgggggagttatcgtttgggcccacactggggccagggaacctggtcgtcgtctcctcagcttccaccaagggcccatcgtcttcccctggcgccctgctccaggagcacctctgggggcacagcggccctgggctgcctggtcaaggactacttcctatatactgtctgagcgggctggcaaggcgcatag

SEQ ID NO: 790614 - DNA, 713 bp, Homo sapiens
  misc_feature: 15541.44.85.H08.1.pb.heavy.1.raw 15541
ctatgcgccttgccagcccgctcagacagtatataggaagtagtcctgaccaggcagcccaggccgctgtgcccccagaggtgctcttggaggagggtgccaggggaagacgatgggcccttggtggaggctgaggagacggtgacgtggtcccttggcccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatcagacgctgcacaggagagtctcagggacctcccaggctggaccacgcctcccccagactccaccagctgcacctgacactggacacctcttaaagagcaacgaggaaacccagctcagcccaaactccatggtgagtcctctgtgttcagtgctgatcaccgaatggaaacaccgccgacttctagtgctgggctcctctcccagagctccccgcgactgagtgatactaaatcgagcaccggtcgtgtatatactgtctgatggcgcgaggaggcgatacg

SEQ ID NO: 790615 - DNA, 685 bp, Homo sapiens
  misc_feature: 15544.44.67.G01.1.pb.heavy.1.raw 15544
ctatgcgcctgccagcccgctcagacagtatataggaagtagtccttgaccaggcagcccagggccgctgtgcccccagaggtgctcttggaggagggtgccagggggaagaccgatgggccctggtggaggcgagcgacggtgaccagggttccctggccccagaagtcaaacgaataataaccactccgagcgccgacttgtctcgcacagtaatagacggccgtgtcgtcgcctctcagttgttcatttgaagataaaaccgtgttcctggaattgtccctggagatggtgaatcgcccttcacggagtctgcgtagtatgtgaaatcaccagtataaatgactgagacccactcagccccttcctggagcctggcggacccaactcatgtagttgctgctgacggtgagccagaggctgcacaggagagtctctgggaccccccaggctggactaagcctcctccagactccatcagccgcacctcacactggacaccttttaaaagtccaacaaggagaacccgctcagcaaaactccatggtgagtcctctgtgtcagtgctgatcaccgaatggaaacacctcgaatccagtgctggctcctctccccccaaacccatatgtatactctaaatcgagcaccggtcgtgtatatactgtctgatggcgcgagggaggcg

SEQ ID NO: 790616 - DNA, 722 bp, Homo sapiens
  misc_feature: 15550.44.33.C11.1.pb.heavy.1.raw 15550
cgtatcgcctccctcgcgccatcagacagtatatacacgaccggtgctcgatttagagtgagctcgttgggttggggagctctgggagaggagcccagcaccagaagtcggcggtgtttccagtcggtgatcagcaccgaacacagaggactcaccatggagtttggctgacctgggttttctcgttgctcttttaagaggtgtccagtgtcaggtgaagctggtggagtctgggggaggcgtggtccagcctgggaggtccctgagactctcctgtgtagcgtctggttcaccttcaacagacatggcatgcactgggtccgcaggctccaggcaagggactggagtgggtggcacttatatggtatgatggaagtaataaatattatgtagattccgtgaagggccgattcaccatctccagagacaattcgaagaacacactatatctggaaatgaatagcctgaagccgaggacacggctgtctactactgtgcgagagatggggctcgtggatacagatatgacatgctctactccaatggtatggacgcctggggccaagggaccacggtcgccgtctcctcagcctccaccaagggcccatcggtcttcccctggcaccctcctccaagagcacctctgggggcacagcggccctgggctgcctggtcaagactacttcctatatactgtctgagcgggctggcaaggcgcatag

SEQ ID NO: 790617 - DNA, 703 bp, Homo sapiens
  misc_feature: 15561.UNK.UNK.UNK.pb.heavy.1.raw 15561
cgtatcgcctccctcgcgccatcagacagtatatacacgaccggtggctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggcccccagtaggggggtccctgagactctcctgtgcagcctctggattcaccttcgataattggaatatgcagtgggtccgccaggctccaggcgagggctggagtggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccacaagggcccatcggtcttccccctggcgccctgctccaggagcacctccgagagcacagcggccctgggctgcctggtcaaggactacttccatatactgtctgagcgggctggcaaggcgcatag

SEQ ID NO: 790618 - DNA, 633 bp, Homo sapiens
  misc_feature: 15573.UNK.UNK.UNK.pb.heavy.1.raw 15573
cgtatcgcctccctcgcgccatcagacagtatatacacgaccggtgctcgatttagtgtggagtagtttgggtttgggtgccgagttgctggaggtcacggtcaccacgctgctgaggtgaagaagcctggggcctcagtgacagtctcctgcacggcttctggatacacgttcatcaattatgatatattaactgggtgcggacaggccgctggacaagggctggagtggatgggatggatgaagccctatagtggcaacacgggctttgcccagaagttccaaggcagagttagtaatgaccaggagcacctcgccccaggtaacaatggaaactgggtctgagcacctgagactcagcgccgggcttttctaatgggacgtcggcagcccctgagatctgaggaccacggccggtgtatttctgtgcgagatccaggccaccagcacctggcttgacttgtggggccagggaaccctggtaccgtctcctcagcctcccaccagggcccatcggtcttccccctggcgccctgctccaggagcccacctccgagagcacagcggccctgggctgcctggtcaaggaactacttcctatatactggtctgagcgggctggcaggcgcatag

SEQ ID NO: 790619 - DNA, 705 bp, Homo sapiens
  misc_feature: 15575.44.36.D03.1.pb.heavy.1.raw 15575
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtggaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790620 - DNA, 729 bp, Homo sapiens
  misc_feature: 15583.UNK.UNK.UNK.pb.heavy.1.raw 15583
cgtatcgcctccctcgcgccatcagacagtatatacacgacccggtgctcgatttagagtgagctcgttgggtttgggctgggagaggagcccagcaccagaagtcggcggttgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggagtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgaacatgctctactccaatggtatggacgcctggggccaagggaccacggttcgccgtctcctcagcctccaccaagggcccatcggtcttccccctggcaccctcctccaagagcacctctgggggcacagcggccctgggctgcctggtcaaggactacttcctatatactgtctgagcgggctggcaaggcgcaatag

SEQ ID NO: 790621 - DNA, 677 bp, Homo sapiens
  misc_feature: 15604.UNK.UNK.UNK.pb.heavy.1.raw 15604
cgtatcgccctccctcgcgccatcagacgtatatacacgacgtgctcgatttagtatcactcagtcgcgggggagaggagcccagcactagaagtcggcagtgtttccattcggtgatcagcactgaacacagaggactcaccatggagtttggctgagctgggtttcctcgtgctctttaagaggtgtccagtgtcagtgcagctggtgagtctggggagcgcggtccagcctggaggtcctgagactccctgtgcagcgtcggattcaccttcagtacctatggcatgcactgggtccgcaggctccagcaaggggctgagtgggggcacttatatggtagatggagtaataaaactatgcagactccgtgaagggcgattcaccatctcagagacaattcaagaacacgctgtatctgcaatgaacagcctgagagccgaggacacggctgtgtattactgtgcgaggacatatgtgtagtactacacctgctggatactactacggtatgacgtctgggccaaggaccacgtcccgtctcctcagcctccaccaaggcccatcggtcttccccctggcaccctcctccaagagcactctggggcacagcggccctggctgcctggtcaggactacttcctaatactgtctgagcgggcctggcaaggcgctag

SEQ ID NO: 790622 - DNA, 603 bp, Homo sapiens
  misc_feature: 15606.UNK.UNK.UNK.pb.heavy.1.raw 15606
cccgacacgcttgctaggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccaccctatcaccccccacatagcctgcttggggtgttgagtttacttttatttcgtgttggaatgagttgaacttccgggagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgccagccttc

SEQ ID NO: 790623 - DNA, 669 bp, Homo sapiens
  misc_feature: 15617.UNK.UNK.UNK.pb.heavy.1.raw 15617
ctatgcgcccttgccagccgccgctcagacagtatatagaagtagtccttgaccaggcagcccagggccgcgctgttgcccccagaggtgctcctggaggcagggcgccaggggaagaccgatggggccctggtggaagctgaggagacagtgacccagggcggccacggcccatagattgaaagaccagtctcgccctcgcacagaaataaacggccgtgtccgcggccgggtcacggaggtcagtttcagggagaaagcgcgttcatggacgtgtccctcgaaatggtgagacgactctgagggacggagagtagtacgtcgcgcccagtatacatggatgtccaccaatccactccattccttccctgggggctgccggatcccagccccaagaatgatcagagaactgatggaaactccagagacagtgcagatgaacgacagggttccccgaaggcctcaccatcctggcccgactcccctgcagctgcacctgggacaggacccatctgggagctgccaccagcaggaggaaaaaccacaggtgcttcatgttcttgcacggaggtccttgactctcagaaagcccccaatccctaatcacgtgtactaaatcgagcaccgtccgtgttatactgtctgatggccgcggagggaggcgatacg

SEQ ID NO: 790624 - DNA, 692 bp, Homo sapiens
  misc_feature: 15632.UNK.UNK.UNK.pb.heavy.1.raw 15632
cgtatcgcctcctcgcgccatcagacagtatatacacgaccgtgctcgattagacgcgatcgaagggtttggggctgggagacgagcccagcactgaagtcgccgtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctgagtgggtggcaggtgtgtcatttcatggaggaaatcagtctacggtgattccgtgaggccgattcaccatctccagagacaattccgagaacacagtgtctcttcaaatgaacagcctgagacctcaggacacggccgtgtatttttgtgcgagactatctgtttccaaaatcggttcattcgacgctggggccagggaaccctggtcaccgtctcctcggcctccaccaagggccatcggtcttccccctggcgccctgctccaggagcactccgagagcacagcggccctgggctgcctggtcaaggactacttcctatatactgtctgagcgggctggcaaggcgcatag

SEQ ID NO: 790625 - DNA, 693 bp, Homo sapiens
  misc_feature: 15660.UNK.UNK.UNK.pb.heavy.1.raw 15660
cgtatcgcctcctcgcgccatcagacagtataacgaccgtgctcgatttagctgcgtcacgatctctcttgggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggagacttggtccagcctggagggtccctgagactctcctgtgtcgcctctggattcccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctctcagcctccaccaagggcccatcggtcttccccctggcgccctgctccaggagcacctccgagagcacagcggccctggctgcctggtcaaggactacttcctatatactgtctgagcgggctggcaggcgcatag

SEQ ID NO: 790626 - DNA, 615 bp, Homo sapiens
  misc_feature: 15669.44.23.C01.1.pb.heavy.1.raw 15669
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtcgcggcggtcacggaggtcagtttcagggagaagcggttcatggacgtgtccctcgaaatggtgagacgactcttgagggacggagagtagtacgtcgccccagtataatggatgtcaccaatcactccattccctccctgggggctgccggatccagccccaagaatgatcagaactgatggaaactccagagacagtgcagatgagagacagggttccgaaggcctcacagtcctgggcccgactcctgcagctgcacctgggacaggacccatctgggagctgccaccagcaggaggaaaaaccacagtgttcaccctgccccaatccctaatcacgtgtactaaatcgagcaccggtcgtgtatatactgtctgatggcgcgagggaggcgatacg

SEQ ID NO: 790627 - DNA, 570 bp, Homo sapiens
  misc_feature: 15685.UNK.UNK.UNK.pb.heavy.1.raw 15685
cgtatcgcctccctcgcgccatcagacagtatatacacgaccgtgctcgatttagtgtgagtagtttgggtttgggtgccgaaagttgctggaggtcacggtcaccacgctgctgaggtgaagaagcctggggcctcagtgacagtctcctgcacggcttctgatacacgttcatcaattatgatattaacgggtgcgacaggccgctggacaagggctggagtggatgggatggatgaagccctatagtggcaacacggcttgcccagaagttccaaggcagagttagtatgaccaggagcaccctccccaggtacagtctacatggaactggagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctggctgcctggtcaaggactacttcctatatactgtctgagcgggctggcaaggcgcatag

SEQ ID NO: 790628 - DNA, 654 bp, Homo sapiens
  misc_feature: 15699.UNK.UNK.UNK.pb.heavy.1.raw 15699
ctatgcgccttgccagcccgctcagacagtatataggaagtagtccttgaccaggcagcccagggccgctgtgcccccagaggtgctcctggagcagggcggccagggggaaagaaccgatgggcccttggtggaagctgaggagaacagtgaaccagggtgccacggccccatagattgaaaaagaccagtctccgcctcgcacaagaaaataaaacggccgtgtgtccgcgcggtcacgggaggtcagtttttcagggagaaagcggtttcatggacgtgtccctcgaaattggtgagacgactcttgagggacgggaagtagtacgtcgccccagtaataatggatgtcaccaattcactccattcccctccctgggggggctgccgggatccagccccagatgatcagaaactgatggaaactccagagacagtgcagatgagaagacagggttcccgaaggcctcaccagttcctgggcccggactcctgcagctgcacctgggacaggacccatctgggagctgccaccagcaggaggaaaaaaaccaacaggtgtttcaccctgccccaatccctaatcacgtgtacttaaatcgagcaccggtcggtgtaatatactgtttcttgatggcgcgaggaggcgatacg

SEQ ID NO: 790629 - DNA, 613 bp, Homo sapiens
  misc_feature: 15740.UNK.UNK.UNK.pb.heavy.1.raw 15740
agaaggctgggcaggctatgcaccctggtccaggtcaaaagctgcggaacccgctagcggccatccttggccactaggggtcccgcagattcatattgtcgtctagcatgcacaatgctgcaaacccagcttgcaatgcccacagcaagcggccaatctttacgccacgttgaattgtttattacctgtgactggctatggcttgcacgccactcgtaaaactagtactttgcggttaggggaagtagacaaacccattactccacttcccggaagttcaactcattccaacacgaaataaaagtaaactcaacaccccaagcaggctatgtgggggggggtgataggggtggattctatttcctatcccatcccctaggatctcaattaagttactagcgagttaaatgtctgtagcgatcccgtcagtcctatcgcgcgcatcaagacctggtttggttgagcgtgcagtagatcatcgataagctgcgagttaggtcatcccagaccgcatctggccgcctaaacgttcagtggtagctaaggcgtcaccttcgactgtctaaaggcaatatgtcgtcctttagctccaagtccctagcaagcgtgcggg

SEQ ID NO: 790630 - DNA, 725 bp, Homo sapiens
  misc_feature: 15743.UNK.UNK.UNK.pb.heavy.1.raw 15743
tcgtatcgcctccctcgcgccatcagacagtatatacacggaccggtgctcgatttagcactcgcacgttgggtttggggggagaggagcccagcactgggattccgaggtgtttccattcggtgatcagcactggaacacagaggactcacatggagttttggctgagctgggtttctccttgttggacttttaaaaggtgtccagtgtgaggtgcggctgatggagtctggaggaggcttagtccagcctggggggtcccaaggactctcctgtgcagcctctggggctcaccgtccagcagcaactacatggagttgggtcccgcaggctccagggaaaggggctggagtgggtctcagttcatttatactgtggaatttcaaaatactacgcagactccgtggaagggccgattcaccatctccagggacaattccaggaaacacggttttatcttcaaatgaacaacctgagaggcgacgacacggccgtctattactgtgcgagacaagtcggcgcttcggagtggttattattcgtttgacttctggggccaggaaccctggtcaccgtcgcctccgcctccaccaagggcccatcggtcttccccctggcaccctcctccaagagcacctctggggcaaacagcggccctgggctgcctggtttcaaggactaacttcctaatatactgttctgaagcgggctggcaaggcgcatag

SEQ ID NO: 790631 - DNA, 700 bp, Homo sapiens
  misc_feature: 15762.44.27.C05.1.pb.heavy.1.raw 15762
cgtatcgcctccctcgcgccatcagacagtatatacacgaccggtgctcgatttagacgcgatcgaagggtttgggggggaagaggaagtcgccggtgtttccactcggtgatcatcactgaacacagagactcaccatggagtttgggctgagctgggttttcctcgttgccctcttaagaggtgtcatgtgtcaggtgcaaattcgtggagtctgggggaggcgtggccccagtagggggggtcccctgagactctcctgtgcagcctctggattcaccttcgataattggaatatgcagtgggtccgccaggctccaggcgaggggctggagtgggtggcaggtgtgtcatttcatggaggaaatcaagtctaacggtgattccgttgaggggccgattcaccatctccagagacaattccgagaacacagtgtctcttcaaatgaacgcagcctgagacctcaggacacggccgtgtatttttgtgcgagactatctgtttccaaaatcggttcattcgacgcctgggggccagggaaccctggtcaccgtctcctccggcctccaccaagggcccatcggtcttccccctggcgccctgctccagaggagcacctccgagagcacagcggccctgggctgcctggtcaaggactacttcctatatactgtctgagcgggctggcaaggcgcatag

SEQ ID NO: 790632 - DNA, 552 bp, Homo sapiens
  misc_feature: 15772.UNK.UNK.UNK.pb.heavy.1.raw 15772
ctatgcgccttgccagcccgctcagacagtatataggaagtagtccttgaccaggcagcccaggccgctgtgcccccagaggtgctcctggagcagggcgccagggggaagaccgatgggcccttggtggaagctgaggagacggtgaccagggttccctggccccaggggtcgaaccacctcccgacgagctgctatacctttcgggatctcgcacagtaatacacggccgtgtcctcagatctcaggctgctcagctccatgtaggcctgtgtttatggaggtgttcctggtcatggtgactctgccctggaacttctgtgcatagcctgtgttaccactgttagggttcatccatcccatccactcaagcccttgtccagtggcctgtcgcacccagttgatatcataattggtgaaggtgtatccagaagccttgcaggagacttcactgaggccccaggcttcttcacctcagccccttactggctagtctaaatcgagcaccgggtcgtggtatatactgtctgatggcgcgagggaggcgatacg

SEQ ID NO: 790633 - DNA, 602 bp, Homo sapiens
  misc_feature: 15784.UNK.UNK.UNK.pb.heavy.1.raw 15784
ctatgcgccttgccagcccgctcagacagtatataggaagtagtccttgaccaggcagccagggccgctgtgccccccagaggtgctcctgagcagggcgccaggggagaagaccgatgggcccttggtggaagctgaggagacggtgaccgtggtccctttgccccagacgtccagatggtaagacttataatacagaaacagctgtttctttcccgcattacccgtgcacagtaatatgtgcctgtgtccgcagggtccatgtggtcatactaaagaccacctgccttttggaggtgtccttggagatggttaaactgctctcagagatgtactgtaggattgcgccattcgggaagatgtgtgcagcactccaggggccttcctggggctgacgatcccagctcacacccattctaatatcgttgagagagaacccagagatggtgcaggtcagcgtggagggtctctgtggtttcaccagcacagaccagactccttcaaggtgacctgggacaagacccaagagagagatcgtgacgcaggctaatcgagcaccggtcgtgtatatactgtctgatggcggccgaagggaggcgaac

SEQ ID NO: 790634 - DNA, 656 bp, Homo sapiens
  misc_feature: 15818.UNK.UNK.UNK.pb.heavy.1.raw 15818
ctatgcgcctgccagccgctcagacagtatataggaagtagtccttgaccaggcagcccagggccgctgtgcccccagaggtgctcctggagcagggcgcccagggggaagaccgatgggcccttggtggaagctgaggagacagtgaccaggggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtaacgtcgccccagtataatggatgtcaccaatccactccattccccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatccccaaacccaagtctatagcactaaatcgagcaccggtgtgtatatactgtctgatggcgcgagggaggcgatacg

SEQ ID NO: 790635 - DNA, 618 bp, Homo sapiens
  misc_feature: 15872.44.23.C01.1.pb.heavy.1.raw 15872
ctatgcgccttgccagcccgctcagacagtatataggaagtagtccttgaccaggcagcccagggccgctgtgccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcaggagaagcggttcatggacgtgtccctcgaaatggtgagacgactcttgagggacggagagtagtacgtcgccccagtataatggatgtcaccaatccactccattcccctccctgggggctgccggatccagcccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgttcaccctgccccaatccctaatcacgtgtactaaatcgagcaccggtcgtgtatatactgtctgatggcgcgagggaggcgatacg

SEQ ID NO: 790636 - DNA, 596 bp, Homo sapiens
  misc_feature: 15881.UNK.UNK.UNK.pb.heavy.1.raw 15881
cccgacacgcttgctagggacttggagctaaggacgacatattgccttagacagtcgaaggtgacgccttagctaccactgaacgtttaggcgccagatgcggtctgggatgacctaactcgcagcttatcgatgatctactgcacgctcaaccaaccaggtctgatgcgcgcgaggacgacgggatcgaatacagacatttaactcgctagtaactgaattgagatcctaggggatgggataggaaatagaatcacccctatcaccccccacatagcctgcttggggtgttgagtttacttttattcgtgtggaatgagtgaacttccgggaagtggagtaatgggttttgtctacttccctaacgcaaagtactagttttacgagtggcgttgcacagccatagccagtcacaggtaaataaacaattcaacgtggcgtaaagattgggccgcttgctgtggcatgcaagctgggtttgcagcattgtgcatgctagaacgacaatatgaatctgcgggacccctagtgccaagatggcgctagcgggttccgcagctttgacctggaccagggtgcatagcctgcccagcctt

SEQ ID NO: 790637 - DNA, 697 bp, Homo sapiens
  misc_feature: 15893.44.55.E11.1.pb.heavy.1.raw 15893
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggcccagaagtcaaacgaataataaccactccgagcgccgacttgtctcgcacagtaatagacggccgtgtcgtcgcctctcaggttgttcatttgaagataaaccgtgttcctgaattgtccctggagatggtgaatcggcccttcacggagtctgcgtagtatgtgaaatcaccagtataaatgactgagacccactccagcccttccctggagcctggcggacccaactcatgtagttgctgctgacggtgagcccagaggctgcacaggagagtctctgggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaaccaacgtgcgagtgctaaatcgagcaccggtcgtgtatatactgtctgatggcgcgaggaggcgatacg

SEQ ID NO: 790638 - DNA, 711 bp, Homo sapiens
  misc_feature: 15913.44.33.C11.1.pb.heavy.1.raw 15913
ctatgcgccttgccagcccgctcagacagtatataggaagtagtccttgaccaggcagcccagggcgctgtgccccagagtgctcttggaggagggtgccaggggaagaccgatggccccttggtggaggctgaggagacggcgaccgtggtccttggcccaggcgtccatacattgagtagagcatgtcatatctgtatccacgagcccatctctcgcacagtagtagacagccgtgtcctcggctctcaggctattcatttccagatatagtgtgttcttcgaattgtctctggagatggtgaatcggccttcacggaatctacataatatttattacttccatcatacatataagtgccaccactcagtcccttgcctggagcctggcggaccagtgcatgccatgtctgttgaaggtgaatccagacgctacacaggagagtctcagggacctccaggctggaccacgcctccccagactccaccagcttcacctgacactggacacctcttaaaagagcaacgaggaaaacccaggtcagccaaactccatggtgagtcctctgtgttcggtgctgatcaccgactggaaacaccgccgacttctggtgctgggctcctctcccagagctcccaaacccaacgagctcactctaaatcgagcaccggtcgtgtatatactgtctgatggcgcgaggaggcgatacg

SEQ ID NO: 790639 - DNA, 605 bp, Homo sapiens
  misc_feature: 15916.UNK.UNK.UNK.pb.heavy.1.raw 15916
ccgacacgcttgctaggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 790640 - DNA, 688 bp, Homo sapiens
  misc_feature: 15942.UNK.UNK.UNK.pb.heavy.1.raw 15942
ctatgcgctcttgccagcccgctcagacagtatatataggaagtagtcccttcgaccaggcaggcccagggccggcgctgtgcccccagaggtgctcctggagcagggcggcccaggggaagaccgatgggccccttggtggaagctgaggagacagtgaccagggtgccacggccccatagattgaaagaccagtctccgcctcgcacagaaataaacggccgcgcgtgttccgcggcgcggtcacggaggtcagtttcagggagaagcggttcatggacgtgtccctcgaaatggtgagacgactcttgagggacggagagtagtacgtcgccccagtataatggatcgtcaccaatccactccattcccctccctggggggctgccggatccagcccccaagaatgatcagaactgatggaaactccagagacagtgcagatgagagacagggttccccgaaagcctcaccagtcctgggcccgactcctgcagcctgcacctgggacaaggacccatctgggagctgccaccagcaggaggaaaaaccacaggtgcttcattgttcttgcacaggaggtccttgactctcagaaagcatcccccaaaccccaagtctatagcactaaatcggagcacgggtcgttggtatatatactgtctgatggcgcgagggaggcgatacg

SEQ ID NO: 790641 - DNA, 724 bp, Homo sapiens
  misc_feature: 15964.UNK.UNK.UNK.pb.heavy.1.raw 15964
tatgcgccttgcagccgctcagacaagtataggaagtagtcttgacaggcagcccagggccgctgtgcccccagaggtgcctcttggaggagggtgccagggggaagaccgatggcccttggtggaggctgaggagacggtgaccggtggtcccttggcccagacgtccataccgtagtagtagtcccagcaggctggtagtactacaatatgtcctcgcaccagtaatacacagccggtgtcctcggctctcaggctgttcatttgcagatacagcgtgttcttggaattgtctctggacgatggtgaatcggcccttcacggagtctgcatagtatttattacttccatcataccattataagtgccacccactccagccccttgcctggagcctggcggacccagtgcatgccataggtagctgaaggtgaatccagaacgctgcacaggagagtctcaaggacctcccaggctggaccacgcctccccagactccaccagctgcacctgacactggacacctcttaaaagagcaacgaggaaaaccccagctcagcccaactccatggtgagtcctctgtgttcagtgctgatcaccgaatggaaacaccgccgacttctagtgctgggtcctctccagagctccccgcgactgagtgatactaaatcgagccaccgggtcgtgtatatactgtctgatggccgcgagggaggcgatacg

SEQ ID NO: 790642 - DNA, 704 bp, Homo sapiens
  misc_feature: 15975.44.36.D03.1.pb.heavy.1.raw 15975
gtatcgcctccctgcgccatcagaccagtatatacacgaccggtgctcgatttagctgcgtcacgatctctcttggggagctctgagagcggagccccagccccagaattcccaggtgttttcattttggtgatcagcactgaacacagaggactcaccatggagttcgggctgagctggggttttccttgttgttattttacaaggtgtccagagtgaaagtgcagttggtgggtccgggggagacttgtccagcctggagggtcctgagacttcctggtccgcctctggattcaccatcagtgaccactatatggactgggtccgccaggctccagggaagggctggagtggcttggccgcagtaaaaacaaagttgccagctttatcacagagtacgccgcgtctgtgaaagccagatcaccctctcaagagatgacttcaagaactcattgattctgcgaatgactaacctgaaaaccgaggacacgggcatgtatattgtgttgtgtttatatcaggaactgtccactggggccagggaaccctggtcaccgcgtctcctcagcctccaccaagggcccatcggtcttccccctggcgccctgctccaggagcacctccgagagcacagcggccctgggctgcctggtccaaggactactttcctatatactgtctgagcgggctggcaaggcgcatag

SEQ ID NO: 790643 - DNA, 673 bp, Homo sapiens
  misc_feature: 15990.44.45.E01.1.pb.heavy.1.raw 15990
ctatgcgccttgccagcccgctcagacagtatataggaagtagtccttgaccaggcagcccagggcgctgtgctctcggaggtgctcctggagcaggcgccaggggaagaccgatgggccttggtggaggctgaggagacggtgaccagggctcctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccaccactccagccccttgcctggagcctggcggacccagtgcatggcagagtcactgaaactgagtccggacgcacacaggagagtctcagggacgtccaggctggaccacgcctccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgaggaggcgatacg

SEQ ID NO: 790644 - DNA, 729 bp, Homo sapiens
  misc_feature: 16004.UNK.UNK.UNK.pb.heavy.1.raw 16004
ctatgcgccttgccagccgcctcagcagtatataggaagtagtttccgaccaggcagcgccagtggcccgctgtgtgcccccagaggtgctcttggaggagggggtgccaggggtgaagaccgatggcccttggtggaggcggaggcgaccggtgaccagggttccctggcccagaagtcaacgaataataaccactccgagcgccgacttgtctcgcacagtaatagaccggccgtgtgcgtcgcctctcagggttgttcatttgaagataaaccgtgttcctgggaattgtcccgggagatggtgaatcggcccttcacggagtctgcgtagtatgtggaaatcaccagtataaatgactgagaccactccagccccttccctggagcctggcggacccaactcatgtagttttgctgctgacggtgagcccagaggctgcacaggagagtcctctgggacccccccaggctggactaaagcctcctccagactccatcaagcccgcacctccacactggacaccttttaaaagtcaacaaggagaaccccaggctcagccaaaaactccatggtggagtcctctgtgttcagtgctgatcaccgaatggaaacacctcggaatcccgtgctgggctcctcctcccccccaaaccccaacgtgcgagtgctaaatcgagcaccggtctcgggtatatactgtctgatggcgcgagggaggcgatacg

SEQ ID NO: 790645 - DNA, 620 bp, Homo sapiens
  misc_feature: 16046.UNK.UNK.UNK.pb.heavy.1.raw 16046
cccgacacgcttgctaggggaacttggagctaaaggacgacatattgcctttagacagtcgaaggtgacgccttagctaccactgaacgtttaggcgccagaatgcggttctgggatgacctaactcgcagcttatcgatgatctactgcacgctcaaccaaccaggtcttgatgcgcgccgataggactgacgggatcgctacagacatttaactcgctagtaacttaattgagatcctaggggatgggataggaaatagaatccacccctatcacccccccacatagcctgcttgggggtgttgagttttacttttatttcgtgtttggaatgagttgaacttccgggaagtggagtaatgggttttgtctacttcccctaaccgcaaagtactagtttttacgagtggcgttgcaagccatagccagtcacaaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 790646 - DNA, 620 bp, Homo sapiens
  misc_feature: 16048.UNK.UNK.UNK.pb.heavy.1.raw 16048
ctatgcgcctgccagccgctcagacagtatataggaagtagtccttgaccaggcaggcccagggccgctgtggccccagaggtgctcctggagcaggcgccaggggaagaccgatgggcccttggtggaagctgaggagaccggtgaccgtggtccctggccccagacgtccataccgtagtagtagtatgcaactccccgaactcccgcaccggctcttgcacagtaatacacagccgtgtcctcggctctcagactgttcatttggcagatacagcgtgttcttgcgttgtctctggagatggtgacatcggccttcacgggagtccgcgtagcctgtgctactcccatcactattaatacgtgagacccacaccagccccttccctggagcttggcggaccagtgcatccagtagctactgaaggtgaatccagaggctgcacaggagagtctcagggaccccccaggctgaactaagcctcccccggactccaccagctgcacctcacactggacaccttttaaaatagcaacaaggaaaaacccagctatcagatactaaatcgaggcaccggtcggtgtatatactgtctgatggcgcgagggaggcgatacgg

SEQ ID NO: 790647 - DNA, 655 bp, Homo sapiens
  misc_feature: 16050.UNK.UNK.UNK.pb.heavy.1.raw 16050
ctatgcgccttgccagcccgctcagacagtatataggaagtagtccttgaccaggcagccagggccgctgtgcccccagaggtgctcctggagcagggcgccaggggaagaccgatgggcccttggtggaagctgaggagacagtgaccaggggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatcactccatttcccctccctgggggctgccggatccagccccaagaatgatcagaactgatggaaatccagagacagtgcagatgagagacagggttcccgaaggcctcaccagtcctgggcccgactcctgcagctgcacctgggacaggacccatctgggagctgccaccagcaggaggaaaaaccacagggtgcttcatgttcttgcacaggaggtccttgactctcagaaagcatccccaaacccaagtctatagcactaaatcggagcaccggtcgtgtatatactgtctgatggcgcgagggaggcgatacg

SEQ ID NO: 790648 - DNA, 654 bp, Homo sapiens
  misc_feature: 16065.44.53.E09.1.pb.heavy.1.raw 16065
ctatgcgccttgccagcccgctcagacagtatataggaagtagtccttgaccaggcagcagggccgctgtgctctcggaggtgctcctggagcagggcgccagggggaagaccgatgggcccttggtggaggctgaggatgaggagacggtgaccgtggtcccttggccccagacgtcccaagcgtagtagaattgagacgacctgccataggcggacccatgtctgacacagtagtagacagccgtgtcggcggcggccacagaactcactttcagggaaaactgtgtcctcgacgtgtccacggatatggtgactcgaccgttgagggacgggttgtagtaggtgtttcccactataatagagactcccaatccactgcagcccctctcctgggggctggcggatccagccccagtagaaattacttctgtcgatggaggcaccagagaccgtgcacgtgagggacagggtctccgaaggcttcaccagtcctgggcccgactcccgcagctgcggctgagacaggacccatctgggagccgccaccagcaggaggaagaaccacaggtgcttcccccaaacccaacacactctctctaaatcgagcaccggtcgtgtatatactgtctgatggcgcgagggaggcgatacg

SEQ ID NO: 790649 - DNA, 691 bp, Homo sapiens
  misc_feature: 16066.44.53.E09.1.pb.heavy.1.raw 16066
cgtatcgcctccctcgcgccatcagacagtatatacacgaccggtgctcgatttagagagagtgtgttgagctctgggagaggagcccagccttgggattcccaggtgtttttcattcagtgatcaggactgaacacagaggactcaccatggagttttgggctgagcttggatttttccttgctgctattttaaaaggtgtccagtgtgaaggtgcagttggtggagtctgggggaggtttggtaaagcctgggggagtcccttagactctcctgtgcagcctctggatttcactttcagtaaccgcctggatgacctgggtccgccaggctccagggaaggggctggagtgggttggccgtattagaaccaaagctgacggtgggacagcagactacgctgccacccgtgaaaggcagattcaccatctcaagagatgattcaaaagatacggtgtctctgcagatgaaacagcctgaacaccgaggacacagccgtctattactgtctgggatggtttcattcgggccagggaaccctggtcaccgtctcctcagcctccaccaagggcccatcggtcttccccctggcgcctgctccaggagcacctccgagagcacagcggccctgggctgcctggtcaaggactacttcctatatactgtctgagcgggctggcaaggcgcatag

SEQ ID NO: 790650 - DNA, 731 bp, Homo sapiens
  misc_feature: 16070.44.39.D06.1.pb.heavy.1.raw 16070
ctatgcgccttgccagcccgctcagacagtatataggaagtagtccttgaccaggcagcccagggccgctgtgccccagaggtgctcctggagcagggcgccagggggaagaccgatgggcccttggtggaagctgaggagacggtgaccgacgtcccccctgccccagacatccatcaaatagtagtagtttatgattccccgaaccgtttccttggaggtccccctcgcacagtaataaaacagacgtgtcgtcaactctcacgctgttcatttgcaaatacagcatattcttggaattgtctctggagatggtgaatcggcccttcacggagtctgagtaatacttctcacttccatcgtcggagatgactgccacccactccggccccttgcctggagcctggcggacccagtgcaaaccaaatctatcgaatgagaacccagaggctacacaggagagtctcagggacctcccgggctggaccacgcctcccccagactccaccaagtgctcctgacactggacacctcttaaaagagcaacgaggaaaacccagctcagcccaaactccatggtgagtcctctgtgtttcagtgatgatcaccgaatggaaacaccggcgacttccagtgctgggctcgtctctccccaaagaactggcgagatgtcactaaatcgagcaccggtcgtgtatatactggtctgatggcgcgagggaggcgatacg

SEQ ID NO: 790651 - DNA, 652 bp, Homo sapiens
  misc_feature: 16082.44.86.H09.1.pb.heavy.1.raw 16082
cgtatcgcctccctcgcgccatcagacagtatatacacgaccggtgctcgatttagtgctatagacttgggtttggggatgctttctgagagtcaggacctcctgtgcaagaacatgaagcacctgtggtttttcctcctgctggtggcagctcccagatgggtcctgtcccaggtgcagctgcaggagtcgggcccaggactggtgaggccttcggaaccctgtctctcatctgcactgtctctggagtttccatcagttctgatcattcttggggctggatccggcagcccccagggaggggaatggagtggattggtgacatccattatactggggcgacgtactactctccgtcctcaagagtcgtctcaccatttcgagggacacgtccatgaaccgcttctccctgaaactgacctccgtgaccgccgcggacacggccgtttattttctgtgcgaggcgagactggtctttcaatctatggggccgtggcaccctggtcactgttctcctcagcttccaccaagggcccatcgtcttccccctggcgccctgctccaggagcacctctggggcacagcggccctgggctgcctggtcaaggactacttcctatatactgtctgagcgggctggcaaggcgcatag

SEQ ID NO: 790652 - DNA, 692 bp, Homo sapiens
  misc_feature: 16101.44.9.A09.1.pb.heavy.1.raw 16101
cgtatcgcctccctcgcgccatcagacagtatatacacgaccggtgctcgatttagcgagacgcgcagggggggagacgagcccagcactgaagtcgccgtgttttccattcggtgatcatcactgacacagaggactcaccatgcgacttttgggctgagatgggttttcctcgttgctcttttaagaggtggccagtgtcaggtgccagctagtggagtctgggggagagcggccagcctgggaactccctgagactctcctgtgcagcctctggattcatcttcaggacctatgccatgcactggtccgccaggctccaggcaaggggctggagtgggtggcaattatatcagaagatggaattgaagaacactacggagactccgagaagggccgattcaccgtctccagagacaattccaggaacacactgcatctgcaaatgtacaacctcacaagtgaggacacggctgtctattattgtgcgagagccccctcgagacggtcccgcttgactactgggccagggaaccctggtcaccggtctcctcagcctccaccaagggcccatcggtctttcccctggcgccctgctccaggagcacctccgagagcacagcggccctgggctgcctggtcaaggactacttcctatatactgtctggagcgggctggcaaggcggcatag

SEQ ID NO: 790653 - DNA, 708 bp, Homo sapiens
  misc_feature: 16105.44.70.G04.1.pb.heavy.1.raw 16105
cgtatcgcctccctcgcgccatcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggaggcgtggtccagcctgggaggtccctgagactctcctgtgaagcctctggatttagtttcagtggttctggcatgcactgggtccgccaggctccaggcaaggggccggagtggttggcagttatagcacatgatggaagttctgaatattatgcagactccgtgaagggccgattcaccatctccagagacaattcccggaacattgtgtacttggaaatggtcagcctgagagtcgaggactcggctctgtattactgtgcgagatcgggaggtggtagtagttattaccgggcgcatgactggggccaggggaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790654 - DNA, 652 bp, Homo sapiens
  misc_feature: 16113.UNK.UNK.UNK.pb.heavy.1.raw 16113
tatgcgccttgccagccccgctcagacagtatataggaagtagtccttgaccaggcagccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtcgcggcggtcacggaggtcagtttcagggagaagcggttcatggacgtgtccctcgaaatggtgagacgactcttgagggacggagagtagtacgtcgccccagtataatggatgtcaccaatccactccattcccccttgggggctgccggatccagccccaagaatgatagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaaggcattccccaaaccaagtctatagcactaaatcgagcaaaccggtcgtgtatatactgtctgatgcgcgagggaggcgatacg

SEQ ID NO: 790655 - DNA, 651 bp, Homo sapiens
  misc_feature: 16121.44.86.H09.1.pb.heavy.1.raw 16121
ctatgcgccttgccagcccgctcagacagtatataggaagtagtccttgaccaggcagcccaggccgctgtgccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagcccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatcccaaacccaagtctatagcactaaatcgagcaccggtcgtgtatatactgtctgatggcgcgagggaggcgatacg

SEQ ID NO: 790656 - DNA, 615 bp, Homo sapiens
  misc_feature: 16164.UNK.UNK.UNK.pb.heavy.1.raw 16164
cccgacacgcttgctagggacttgagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttgggcgtgttgagtttacttttatttcgtgttggaatgagttgaacttccgggaagtggagtaatgggtttgtctacttttccctaaccgcaaagtactagttttacgagtggcgttgcaagccatagccagtcaccaggtaataaacaattcaacgtggcgtaaagattgggccgcttgccctgtgggcattgcaagctgggtttgcagcattgtgcatgctagacgacaattatgaatctgcgggacccctaggtggccaagatgcgccgctagcgggttccgcagcttttgacctggaccagggtgcatagcctgccagccttc

SEQ ID NO: 790657 - DNA, 698 bp, Homo sapiens
  misc_feature: 16169.44.36.D03.1.pb.heavy.1.raw 16169
cgtatcgcctcctccccccgcgcccatcagacagtatatacacgaccggtgctcgatttagctgcgtcacgatctctcttggggctctgagagcggagccccagccccagaattcccaggtgttttcatttggtgatcagcactgaacacagaggactcaccatggagtttcgggctgagctggttttccttgttgtttatttacaaggtgtcagagtgaagtgcagttggtggagtccggggagattggtccagcctggaggtccctgagactctcctgtgtcgcctctggattcaccatcagtgaccactatatggactgggtccgccaggctcagggaggggctggagtggcttggccgcagtaaaaacaaagttgccagctttatcacagagtacgccggcgtctgtgaaagccagattcacccctctcaagagatgacttcaagaactcatgattctgcgaatgactaacctgaaaaccgaggacacgggcatgtattatgtgttgtgtttatatcaggaactgtcactgggccagggaaccctggtcaccgtctcctcagcctccaccaggccatcgtcttccccctggcgccctgctccaggagccacctccgagagcacagcgggccctggggctgcctgtcaaggactacttcctatatactgtctgagcgggctggcaaggcgcatag

SEQ ID NO: 790658 - DNA, 708 bp, Homo sapiens
  misc_feature: 16178.44.36.D03.1.pb.heavy.1.raw 16178
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtcactgagactctcctgtgtcgcctctggattcaccatcagtgaccactatatggactgggtccggccaggctccagggaagggggctggagtggcttggccgcagtaaaaacaaagttgccagctttatcacagagtacgcgccgtctgtgaaagccagattcaccctctcaagagatgacttcaagaactcattgattctgcgaatgactaacctgaaaaccgaggacacgggccatgtattattgtgttgtgtttatatcaggaactgtccactggggccagggaaccctggtcaccgtctcctcaggcctccacaagggcccatcggtcttcccctggcgcccctgctccaggagcacctccgagagcacagcggccctgggctgcctggtcaaggactacttcctatatactgtctgagcgggctggcaaggcgcatag

SEQ ID NO: 790659 - DNA, 694 bp, Homo sapiens
  misc_feature: 16187.UNK.UNK.UNK.pb.heavy.1.raw 16187
cgtatcgcctccctcgcgccatcagacagtatatacacgacccggtgcctcgattagcactccgcacgttgggtttgggaggaggagcccagcacctgggattccgacggtgtttccattcggtgatcagcacctgaacacagaggactcaccatggagttttggctgagctgggttctccttgttggactttaaaaggtgtccagtgtgaggtgcggctgatggagtctggaggaggcttagtccagcctggggggtccccagagactctcctgtgcagcctctgggctcccgtcagcagcaactacatgagtgggtccgccaggctccagggaagggctggagtgggttctcaagtcacatttatactggtgattttccatactacgcagactcgtgaagggccgatcaccatctccaggacaattccaggaacacggtttatcttcaaagaacaacctgagaggcgacgacacggccgtctatactgggcgagacaagtcggcgctcggagtggtattattcgtttgacttctggggccagggaaaaccctggtcaccgtgcctccgcctccccaagggcccatcggtcttcccgcgcacccccctccaagagcacctctggggcacagcggccctggcgcgcctggtcaagaactacttcctatatactgtctgagcggctggcaaggcg

SEQ ID NO: 790660 - DNA, 636 bp, Homo sapiens
  misc_feature: 16215.UNK.UNK.UNK.pb.heavy.1.raw 16215
ctatgcgccttgccagcccctcagacagtatataggaagtagtccttgaccaggcagccagggccgctgtgcccagaggtgctctggagcagggcgcaggggaagacgatggcccttgtgaagctgaggtgacaatgaccagggttccctgccccagatctcaaaggctcatgcgagctggggtacggacctctcgcacagtagtagacggccgtgtcgtcgatttcaaagaactcattgtcatgagactgtgtctgtggacttgtccgcggtaatcgtaattctgcccgaagtctcgtgcgtaggtagtgagcaaaaagagggatgattcacccatcactcaagcccttgtccaggggcctgggcacccattgatgtataagtagtggaactggtagtacttccagaggccgtgcaggaaagggtcaccgaggaccaaggtgcggcattctagtccaactgcaccagttgcaccaggactggacacctgttgctgctgccacacaaagaggaacctcaggtcagtccatgtgatgagctgtgctccagggcttctttaggagaatgtggttgtcagtagatctaaatcgagcacggtcgtgtatatactgtctgatgggcgagggaggcgatacg

SEQ ID NO: 790661 - DNA, 720 bp, Homo sapiens
  misc_feature: 16251.44.85.H08.1.pb.heavy.1.raw 16251
cgtatcggcctccctcgcgccatcagacagtatatacacgaccggtgctcgattttagtatcactcagtcgcgggagctctgggaaggagcccagcactaggaagttcggcggttttccattcggtgatcagcactgaacacagaggactcacatggagttttgggctgagctgggttttcctcgttgctcttttaagaggtgtccagtgtcaggtgcagctggtggagtctgggggaggcgtggtccagctgggaggtccctgagactctcctgtgcagcgtctggattcaccttcagtacctatggcatgcactgggtccgccaggctccaggcaaggggctgagtgggtggcacttatatggtatgatggaagtaataaatacatgcagactccgtgaaggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaagggcccatcggtcttccccctggcaccctcctccaagagcacctctggggcaccagcggccctgggctgcctggtcaaggactacttcctatatactgtctgagcgggctggcaaggcgcatag

SEQ ID NO: 790662 - DNA, 720 bp, Homo sapiens
  misc_feature: 16280.UNK.UNK.UNK.pb.heavy.1.raw 16280
cgtatcgcctccctcgcgccatcaggacagtaatataacacggacggtgctcgattagcactcgcacgttggtttggggagaggagcccagcactgggattccgaggtttttccattcggtgatcagcactgaacacagaggactcaccatggagttttggctgagctgggttctccttgttgacttttagtttcttgaaaaggtgtccagtgtgaggtgcggcctgatggagtctggagaggcttagtccagcctggggggtcccagagacctctcctgtgcagcctctgggctcaccgtcagcagcagaactacatgagtttgggtccgcaggctccaggaaaagtgggtctggatcattgggtgtttcatatactggtgatttcacaactacgcagactccgtgaaagggccgattcaccatctccagggacagattccaggacacggtttatctcaaatgaacaaccctgagaggcgacgacacggccgtactattactgtgcgagacaagtcggcgctcggagtggttcattgattcgtttgacttctggggccagggcaaccctggtcacggtcgcctccgcctccaccaaggcctcatcggtttcccctggcaccctcctccaagagcacctctggggcacagcggccctgggctgcctggtcaaggactacttcctattatactgtctgagcggggctggcaaggcgcatag

SEQ ID NO: 790663 - DNA, 607 bp, Homo sapiens
  misc_feature: 16337.UNK.UNK.UNK.pb.heavy.1.raw 16337
gaaggctgggcaggctatgcaccctggtccaggtcaaaagctgcggaacccgctagcggccatctggccactaggggtcccgcagattcatattgtcgtctagcatgcacaatgctgcaaacccagcttgcaatgccacagcaagcggccaatctttacgccacgttgaattgttttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatccagaccgcatctggcggcctaaacgttcagtggtagctaaggcgtcaccttcgactgtctaaaggcaatatgtcgtccttagctccaagtccctagcaagcgtgtcggg

SEQ ID NO: 790664 - DNA, 682 bp, Homo sapiens
  misc_feature: 16356.UNK.UNK.UNK.pb.heavy.1.raw 16356
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccaggggtcgagccagttcgcccccccgtctctactgtatcgataggaatctctcgcacaataatatacggccgtgtccgcggcggtcacagaagtcaatttcagggagaactggttcttggacctgtctagtgacatggtgactcgactcttgagggcggggttgtagttggtgctgccactgttatagatgcgcccaatccactccagtcccttcccggcggactgccgcagccaactccaataataactactgatgtaaccaccagagacattgcagggtgagggacagggtctccgaaggcttcacccgtcctgggcccgactcctgcagctgcacctcggacacgacccatctgggaggtgccaccaggaggaggaagaaccacaggtgtttcatgttcttgtgcaggggggcccatgagtctcagaaagtatccccaaacccaactatcgtgtgctaaatcgagccaccggtcgtgtatatactgtctgatggcgcgagggaggcgatacg

SEQ ID NO: 790665 - DNA, 590 bp, Homo sapiens
  misc_feature: 16360.44.78.H01.1.pb.heavy.1.raw 16360
cgtatcgcctccctcgcgccatcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttcccctggcgccctgctccaggagcacctccgagagcacagcggccctgggctgcctggtcaaggactacttcctatatacttctgagcgggctggcaaggcgcatag

SEQ ID NO: 790666 - DNA, 668 bp, Homo sapiens
  misc_feature: 16400.UNK.UNK.UNK.pb.heavy.1.raw 16400
cgtatcgcctccctcgcgcccatcagtctatactatcagcgaccggtgctcgattagtagtgtagattccgcgcggggctttctgagagtcatggacctcctgttgcaagaacatgaagcaccctgtggttcttcctcctgctggtggcgctccagatggtcctgtcccagctgcagctgcaggagtcgggcccaggactggtgaagcctttcggagaccctgtcctcacctgcactgtctctggtggctccatcagcagtagtagttacactgggctggatccgccagcccagggaagggctggagtggatgggagtatctattatagtgggagcacctactacaacccgtccctccaagagtcgagtcaccatagcagtagacacgtccaagaaccagtttctccctgaagctgaggctctgtgaccgccgcggacaacggccgtgtattactgtgcgagagtaggggcagtttcgtcaccaactactttgacccacttggggccaggaacccctggtcaccgtctcctcagctccacccaagggcccatcggtcttccctggccaccctcctgccaagagcaccttctgggggccagcggcccggggctgcctggtcaggactacttccctatatactgtctgagcgggcctgcaaggcgcatag

SEQ ID NO: 790667 - DNA, 670 bp, Homo sapiens
  misc_feature: 16422.44.23.C01.1.pb.heavy.1.raw 16422
cgtatcgccctccctcgcgccatcagacagtatatacacgaccggtgctcgatttagtacacgtgattagggattggcgggctttctgagagtcaaggacctcctgtgcaagaacatgaagcaacctgtggttttttcctcctgctggtggcagctcccagatgggtcctgtcccaggtgcagctgcaggagtcgggcccaggactggtgaggccttcgggaaccctgtctctcatctgcacctgtcctctggagtttccatcagttctgatcattcttggggctggatccggcagcccccagggaggggaatggagtggattggtgacatccattaactggggcgacgtactactctccgtccctcagagtcgtctcaccatttcgacgggacacgtccgatgaaccgcttctccctgaaactggacctccgtgaccgccggcgggacacggccgtttatttctgtgcggagcgagactggtctttcaatctatgggccgccggtggcaccctggtcacctgtctcctcagctcccaccaaggggcccatcggtcttccccccctggcgcctgctccaggagcacctctgggggcacagcggcccctgggctgccctggtcaaggactacttcctatatactgtctgagcgggctggcaaggcgcatag

SEQ ID NO: 790668 - DNA, 695 bp, Homo sapiens
  misc_feature: 16498.44.55.E11.1.pb.heavy.1.raw 16498
cgtatcgcctcctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcacgtcagcagcaactacatgagttgggtccgccaggctccagggaagggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctcgcctccaccagggcccatcggtcttccctggcaccctcctccaagagcacctctgggggcacagcggccctgggctgcctggtcaaggactacttcctatatactgtctgagcgggctggcaaggcgcatag

SEQ ID NO: 790669 - DNA, 673 bp, Homo sapiens
  misc_feature: 16545.44.6.A06.1.pb.heavy.1.raw 16545
ctatgcgccttgccagcccgctcagacagtatataggaagtagtccttgaccaggcagcccaggccgctgtgcccccagaggtgctcctggagcagggcgccaggggagaccgatgggcccttggtggaagctgaggtgacaatgaccagggttccctgcccccagatctcaaaggctccatgcgagctgggggtacggacctctcgcacagtagtagacggccgtgtcgtcggatttcaaagaactcattgtcatggagactgtgtctgtggacttgtccgcggtatcgtaattctgccccggaagtctcgtgcgtaggtgagtgagccaaaaagagggatgattccacccatccactcaagcccttgtccaggcggcctggcgcacccagttgatggtataagtagtggaactggtagtacttccagaggccgtgcaggaaagggtcaccgaggaccaaggttgcgacatctagtcccagactgcaccagttgcaccagggactggacacctgttgctgctgccaccaaaaagaggaacctccaggtccagtccatggtgatgagctgtgctcccaggggcttctttagaggaggaatgtggttgtcagtagatctaaatcgagcaccggtcgtgtatatactgtctgatggcgcggagggaggcgatacg

SEQ ID NO: 790670 - DNA, 714 bp, Homo sapiens
  misc_feature: 16601.44.36.D03.1.pb.heavy.1.raw 16601
cgtatcgcctccctcggcgccatcagacagtatatacacgaccggtgctcgatttagctgcgtcacgatctctcttggggagcctctgagagcggagccccagccccagaattcccaggtggtttttcatttggtgatcagcactgaacacagaggactcaccatggagttcgggctgagcctgggttttccttgttgttattttacaaggtgtccagagtgaagtgcagttggtggagtccgggggagacttggtccagcctgggagggtccctgagactctcctgtgtcgcctctggattcaccatcagtgaccactatatgggactgggtccgccaggctccagggaagggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccggaggacacgggcatgtattattgtgttgtgtttatatcaggaactgtccactggggccagggaaccctggtcaccgtctcctcagccttccaccaaggcccatcggtcttcccccctggcgccctgctccaggagcacctccgagagcacagcggccctgggctgcctggtcaaggactacttcctatatactgtctgagcgggctggcaaaggcgcatag

SEQ ID NO: 790671 - DNA, 653 bp, Homo sapiens
  misc_feature: 16641.UNK.UNK.UNK.pb.heavy.1.raw 16641
cgtatcgcctccctcgcgccatcagacagtatatacacgacggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcctcacctgcactgtctctggtggctccatcagcagtagtagttactactgggctggatccgccagcccccagggaagggctggagtggattgggagtatctattatagtgggagcacctactacaacccgtcctcaagagtcgagtcaccatatcagtagacacgtccaagaaccagttcttccctgaagctgagctctgtgaccgccgcggacacggccgtgtattactgtgcgagagtaggcagttcgtcaccaactactttgacactggggccaggaacctggtcaccgtctcctcagcctccaccaagggccatcgtcttcccctggcaccctcctccaagagcacctctgggggcacagcggccctgggctgcctggtcaaggactacttcctatatactgtctgagcgggctggcaggcgcatag

SEQ ID NO: 790672 - DNA, 714 bp, Homo sapiens
  misc_feature: 16650.44.67.G01.1.pb.heavy.1.raw 16650
cgtatcgcctccctcgccgccatcagacagtatatacacgaccggtgctcgatttagagtatacatattgggtttggggggagaggagcccagcactggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggcgggtcccagagactctcctgtgcagcctctggctcaccgtcagcagcaactacatgagttgggtcgccaggctccagggaaggggctggagtgggtctcagtcatttatacttggtgatttcacatactacggcagactccgtgaagggccgattcaccatctccagggacaattccaggaacacggtttatcttcaaatgaacaacctgagaggcgacgacacggccgtctattactgtgcgagacaagtcggcggctcggagtggttattattcgttttgacttctggcggccagggaacctggtcaccgtcgcctccgcctccaccaaggggcccatcggtcttcccctgggcaccctcctccaagagcacctctggggggcacagcggcccctgggctggcctggtcaaggacttacttcctatatactgtctgagcgggctggcaggcgcatag

SEQ ID NO: 790673 - DNA, 683 bp, Homo sapiens
  misc_feature: 16651.UNK.UNK.UNK.pb.heavy.1.raw 16651
cgtatcgcctccctcgcgccatcagacagtatatacacgaccggtgctcgatttagagagaggtgttgagctctgggagaggagccccagccttgggattcccaggtgttttcattcagttgatcaggactgacacagaggactcaccatggagtttgggctgagctggattttccttgctgctattttttaaaaggtgtccagtgtgaggtgcagttggtggagtctgggggaggtttggtaaagcctggggagtcccttagactctcctgtgcagcctctggattcactttcagtaacgcctggatgacctgggtccgccaggctccaggaaggggctggagtgggttggccgtattagaaccaaagctgacggtgggacagcagactacgctgcacccgtgaaaggcagattcaccatctcaagagatgattcaaaagatacggtgtctctgcgcgatgaaacagcctgaacaccgaggacacagccgtctattactgtctggatggtttcattcgggccagggaaccctggtcaccgtctcctcagcctccaccaagggcccatcggtcttccccctggcgccctgctccaggagcacctcgagagcacagcggccctgggcgccctggtcaaggactacttcctatatactgtctgagcgggctggcaaggcgcatag

SEQ ID NO: 790674 - DNA, 654 bp, Homo sapiens
  misc_feature: 16652.44.86.H09.1.pb.heavy.1.raw 16652
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtgcaccctggtcactgtctcctcagcttccaccaagggcccatcggtcttccccctggcgccctgctccaggagcacctctggggggcacagcggccctgggctgcctggtcaaggactacttcctatatactgtctgagcgggctggcaaggcgcatag

SEQ ID NO: 790675 - DNA, 688 bp, Homo sapiens
  misc_feature: 16655.UNK.UNK.UNK.pb.heavy.1.raw 16655
cgtatcgcctccctcgcgccatcagacagtaatatacacgaccggtgccgatttagacgtctgaaacacacaaaggggagctctgggagaggagccccagccgtgagattccaggagtttccacttgtgatcagcactgagcacagaccaccaacatggagtttggctaatcttgattttccttgtagtttttttagaggtgtccggcgaggggcgactggcggagtcgggggggggcttggcacagccaggggcggctcgagactctcctgtgtagtctcaggattcgaccctagtgatatcacttgcctgggtccgtcaggctccagggaaggggctgagtggatcacttcgtcagaatgaaacgtatggtgaagtgagtacgccgcgtctgtgagggaagattcaccgtctcaagggatgactccaacagtgtggccatttacaaatgagcacctgagacccgacgacacaggcgtctattactgcgccaggcgattcctgcggccgtcgatgctttgatattggggccaggggacaatgtcaccgtctcttcagcttccacccaagcccatcggtctccccctggcgccctgctccaggagccctctggggcacagcggccctgggctgcctggtcaaggactacttcctatatactgtctgagcgggcctggcagccgcatag

SEQ ID NO: 790676 - DNA, 682 bp, Homo sapiens
  misc_feature: 16671.UNK.UNK.UNK.pb.heavy.1.raw 16671
cgtatcgcctccctcgcgccatcagacagtatatacacgaccggtctcgatttaggctgcgtcacgatctctctgggagagcggagcccagccccagaattccaggtgttttcatttggtgatcagcactgaacacagaggactcaccatggagttcggctgagctgggttttccttgttgttattttacaaggtgtccagagtgaagtgcagttgtggagtccggggagactggtccagccggagggtcctgagactctcctgtgtcgcctctggattcaccatcagtgaccactatatggactgggtccgccaggctccagggaaggggcggagtggcttgccgcagtaaaaacaagttgccagctttatcacagagtacgccgcgtctgtgaaagccagattcacgcctctcaagagatgacttcaagaactcattgattctgcgaatgactaacctgaaaaccgaggacacgggcatgtatttattgtgttgtgttatatcaggaactgtccactggggccagggaacctggtcaccgtctcctcagcctccaccaagggcccatcggtcttcccctggcgccctgctccaggagcacctcgagagcacagcggccctgggctgcctggtcaaggactacttccatatactgtctgagcgggctggcaaggcgcatag

SEQ ID NO: 790677 - DNA, 694 bp, Homo sapiens
  misc_feature: 16682.UNK.UNK.UNK.pb.heavy.1.raw 16682
ctatgcgcctgccagcccggctcagacagtatataggaatagtagtccttgaccaggcagcccagggccgctgtgctctcggaggtgctcctggagcagggcgccaggggaagaccgatgggccctttggtggaggctgaggagacggtgaccagggtttccctggcccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagctttggttctaatacggccaacccactccaggccccttccctggagcctggcggacccaggtcatccaggcgttactgaaagtgaatccagaggctgcacaggagagtctaagggactcccaggctttaccaaacctccccagactccaccaactgcacctcacactggacaccttttaaaatagcagcaaggaaaatccagctcagcccaaactccatggtgagtcctctgtgttcagtcctgatcactgaatgaaaacacctgggaatcccaaggctggggctccttctcccagagctccccaacccaaactactcacactaatcgagcaccgtcgtgtatatactgtctgatggcgccgaggggaggcgatacg

SEQ ID NO: 790678 - DNA, 727 bp, Homo sapiens
  misc_feature: 16683.44.33.C11.1.pb.heavy.1.raw 16683
ctatgcgccttgccagcccgctcagacagtatataggaagtagtccttgaccaggcagcccagggccgctgtgcccccagaggtgctcttggaggagggtgccaggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagccccaaactccatggtgaagtcctctgtgttcggtgctgatcaccgactggaaacaccgccgacttctggtgctgggctcctctcccagccccaaacccaacgagctcactctaaatcgagcaccggtcgtgtatatactgtctgatggcgcgagggaggcgatacg

SEQ ID NO: 790679 - DNA, 708 bp, Homo sapiens
  misc_feature: 16685.44.56.F01.1.pb.heavy.1.raw 16685
ctatgcgccttgccagcccgctcagacagtatataggagtagtccttgaccaggcagcccagggccgctgtgcccccagaggtgctcctggagcagggcgccagggggaagaccgatgggcccttgtggaagctgaagagacggtgaccatgtccctggccccaaatatcaaatgcatcgacgtcccaggatcgcctggcgcagtaaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcagccccttccctggagcctgacggacccaggccaagtgataatcactaagactgaatcctgagactacacaggagagtctcagagaccgccctggctgtgccaagcccccccccgactccgccagtcgccctcgcactggacaccttctaaaaaaactacaaggaaaatcaagattagcccaaaactccatggttggtggtctgtgccagtgctgatcaccaagtggaaactcctgggatctcacggctgggctcctctcccagagctccccttgtgtgttcagacgtctgctaaatcgagcaccggtcgtggtatatactgtctgatggcgcgagggaggcgatacg

SEQ ID NO: 790680 - DNA, 725 bp, Homo sapiens
  misc_feature: 16688.UNK.UNK.UNK.pb.heavy.1.raw 16688
cgtatcgcctccctcgcgccatcagaacagtatatacacgaccggtgctcgattttaggctgcgtccacgatctctcttggggagctctgagagcggagccccagccccagaattcccaggtgttttcatttggtgatcagcactgaaacacagaggactcaccatggagtttcgggctgagctgggttttcctttgttgtattttacaagggtccagagtgaagtgcagttggtggagtccgggggagaacttggtccagcctggagggtccctgaagactctcctgtgtcgcctctggattcaccatcagtgacccactatatggactgggtccgccaggctccagggaaggggctggagtggcttggccgcagtaaaaaacaaagttgccaagctttatcacagagtacgccgcgtctgtgaaaagccagattcacccctctcagaagaatgactttcaaagaactcatgattcctgcgaatgactaacctgaaaaccgaggaacacgggcatgtattattgtgttgtgttttaatcaggaaaactgtccactggggccagggaaccctggttcaccgtctcctcagcctccaccaagggcccatcggtccttccccctggcgccctgctccaggagcacctccgaagagcacagcggccctgggctgcctggtcaaaggactacttcctatactgtctgagcgggctggcaaggcgcatag

SEQ ID NO: 790681 - DNA, 717 bp, Homo sapiens
  misc_feature: 16710.44.85.H08.1.pb.heavy.1.raw 16710
ctatgcgccttgccagcccgctcagacagtatataggaagtagtccttgaccaggcagcccagggccgctgtgccccagagtctcttggaggagggtgccagggggaagacgatgggcccttggtaggctgaggagacggtgaccgtggtcccttggcccccagacgtccataccgtagtagtagtcccagcaggtggtagtactacaatatgtctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggaggcctggcggacccagtgcatggccataggtactgaggtgaatccagacgctgcacaggagagtctcaggaccctcccaggctggaccacgcctcccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggctcctctcccagagctccccgcgactgagtgatactaaatcgagcaccggtcgtgtatatactgtctgatggcgcgaggaggcgatacg

SEQ ID NO: 790682 - DNA, 675 bp, Homo sapiens
  misc_feature: 16727.44.45.E01.1.pb.heavy.1.raw 16727
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggctccctggcccagtagaacgatgggctcgtacaataatagagagccgagtctcggctctcaaattgttcatttgtagatacacggtgttcttggaattgtctctggagacggagaatcggccttcacggagtttccatagtattctttacttccatcagaccagatgactgccacccactccagcccttgcctggagcctggcggacccagtgcatggcagagtcactgaaactgagtccggacgcaacacaggagagtctcaggacgtccaggctggaccacgcctccccagactccaccagctgaacctgacactggacacctcttaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 790683 - DNA, 699 bp, Homo sapiens
  misc_feature: 16729.44.27.C05.1.pb.heavy.1.raw 16729
ctatgcgccttgccagcccgctcagacagtatataggaagtagtccttgaccaggcagcccagggccgctgtgctctcggaggtgctcctggagcagggcgccaggggaagaccgatgggcccttggtggaggccgaggagacggtgaccagggttcctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggcctcaacggaatcaccgtagacttgatttcctccatgaaatgacacacctgccacccactccagccctcgcctggagcctggcggacccactgcatattccaattatcgaaggtgaatccagaggctgcacaggagagtctcagggaccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccaggccccaaacccttcgatcgcgtctaaatcgagcaccggtcgtgtatatactgtctgatggcgcgaggaggcgatacg

SEQ ID NO: 790684 - DNA, 596 bp, Homo sapiens
  misc_feature: 16756.UNK.UNK.UNK.pb.heavy.1.raw 16756
gaaggctgggcaggctatgcaccctggtccaggtcaaaagctgcggaacccgctagcgccatcttggccactagggtcccgcagattcatattgtcgtctagcatgcacaatgctgcaaacccagctgcaatgcccacagcaagcggccatctttacgccacgttgaattgtttattacctgtgactggctatggcttgcaacgccactcgtaaaactagtactttgcggttaggggaagtagacaaacccattactccacttccggaagttcaactcattccaacacgaaataaaagtaactcaacacccaagcaggctatggtggggggtgataggggtggattctatttcctatccatccctaggatctcaattaagttactagcgagttaaatgtctgtagcgatcccgtcagtcctatcgcgcgcatcaagacctggttggtgagcgtgcagtagatcatcgataagctgcgagttaggtcatccagaccgcatctggcgcctaaacgttcagtgtagctaaggcgtcaccttcgactgtctaaaaggcaatatgtcgtccttagctccaagtccctagcaagcgtgtcgg

SEQ ID NO: 790685 - DNA, 670 bp, Homo sapiens
  misc_feature: 16768.UNK.UNK.UNK.pb.heavy.1.raw 16768
cgtatcgccctccctcgcgccatcagacagtatatacacgacccggtgctcgatttagtagtgtagattccgcgggcggcctttctggagagtcatggacgcctcctgtgcaagaacatgaagcacctgtggttcttcctcctgcggtggcggcctcccagatgggtcctgtcccagctgcagctgcaggagtcgggcccaggactggtgagccttcggagaccctgtccctcacctgcactgtctctggtggctccatcagcagtagtagttactactggggctggatcgccagccccccagggaagggctggagtggattgggagtatctattatagtgggagcacctactacaacccgtcctcaagagtcgagtcaccatatcagtagacacgtccaagaaccagttctccctgaagctgagctctgtgaccgccgcggacacggccgtgtattactgtggcgagagtagggcagtttcgtcaccaactactttgacactggggccagggaaccctggtcaccgtctcctcaggcctccaccaagggccatcggtcttcccctggcaccctcctcaagagcacctctgggggggcacagcggccctgggctgcctggtcaaggactacttcctatatactgtctgagcgggctggcaaggcgcatag

SEQ ID NO: 790686 - DNA, 684 bp, Homo sapiens
  misc_feature: 16791.UNK.UNK.UNK.pb.heavy.1.raw 16791
cgtatcgcctccctcgcgccatcagacagtatatacacgaccggtgccgatttagctacgactgcagggaaaggggagagaggagccttagccctggactccaaggcctttccacttggtgatcagcactgagcacagaggactcaccatggaattgggactgagctgggttttccttgttgctattttagaaggtgtcagtgtgaggtgcaactggtggagtctggggaggcttggtccagcctgggggtccctgagactctcctgtgcagcctctggattcacctttagtagttattggatgaactgggtccgccaggctccaggaaggggctggaggggtggccatcatgaagaaagatggaactgagacacactatgtggactctgtgaagggccgattcaccatctccagagacaacgccaagaactcactgtatctgcaaatgaacagtctggagtcgaggacacggctgtgtattattgtgcgggaggcgctgggtggctcattgactactggggtcagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 790687 - DNA, 597 bp, Homo sapiens
  misc_feature: 16811.UNK.UNK.UNK.pb.heavy.1.raw 16811
cccgacacgcttgctagggacttggagctaaggacgacatattgcctttagacagtcgaaggtggacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaactattgagatcctagggggatgggataggaatagaatccaccctatcaccccccacatagcctgctttggggtgttgagttcttttatttcgtgttggaagagttgaacttccggaagtggagtaattggtttgtctacttcccaaaccgcaaagtactagttttacgagtggcgtctgcaagccatagccagtcacaggtaataaacaattcaacgtggcgtaagattggccgctgctgtgggcattgcaagctgggtttgcagcattgtgcagctagacacaatatgaactgcgggacccctagtggccaagatggcccgctagcggttccgcagcttttgacctggaccagggtgcatagcctgcccagccttc

SEQ ID NO: 790688 - DNA, 675 bp, Homo sapiens
  misc_feature: 16812.44.29.C07.1.pb.heavy.1.raw 16812
cgtatcgcctccctcgcgccatcagacagtatatacacgaccggtgctcgatttagagtgctacgaaagggaaaagggggactcctgtgccccaccatggacacactttgctcccacgctcctgctgctgaccatcccttcatgggtcttgtcccagatcaccttgaaggagtctggtcctacgctggtgaagcccacacagaccctccacgctgacctgcaacctctctgggttctcactcaggagtgatggagcgatttgtgggctgggtccgtccagcccccaggaaaggccctggagtggcttgcactcatttattgggatgatgataggccgctacagtccatctctgaagagcagactctccatcaccggagacgcctccaatacgcaggtgatccttagagtggccaacatggccctgcggacacagccacatactactggcgcacacatgatcaactattataaaagtggtggtttatgtgagtggctttgatatctggggccaaagggacaatggtcaccgtctcttcagcctccaccaagggcccatcggtcttccccctggcgccctgctccaggagcacctccgagagcaccagcggccctgggctgcctggttcaaggactacttcctatatactgtctgagcgggctggcaaggcgcatag

SEQ ID NO: 790689 - DNA, 719 bp, Homo sapiens
  misc_feature: 16813.UNK.UNK.UNK.pb.heavy.1.raw 16813
ctatcgcctcctcgccgccatcagacagtatatatacacgaccggtgcctcgatttagcactcgcacgttgggtttggggagaggagcccagcactggattgccgaggtgtttccattcggctgatcagcactgcaacacagaggactcaccatggagtttttggctgagctgggttctcccttgtttggacttttaaaatgtccagtgtgaggtgcgctgatggagtctcggaggaggcttagtccagcctggggggtcccagagactctcctgtgcagcctcgggctcaccgtcagccaagcaactacatgaagttggcgccgcccaggctccagggaaggcggctggagtgggtctcagtcatttatactggtgattctcacatactacgcagactccgtgaaggccgattcaccatctccagggacacattccaggaacaccggtttatcttcaaatgaacaaccctgaggaggcgacgacacggccgtctgattactgtgcgagacaagtcggcgctcggagtggtttattattcgtttgacttctgggccagggaaccctggtcaccgtcggcctccgcctccaccaagggcccatcggtcttcccccctggcaccctcctccaagagcacctctgggggcacagcggccctgggctgcctggtcaaggactacttccttatactggtctgagcgcgctggcaaggcgcatag

SEQ ID NO: 790690 - DNA, 613 bp, Homo sapiens
  misc_feature: 16814.UNK.UNK.UNK.pb.heavy.1.raw 16814
catgcgcgcagcccggcttaaggacttggataaggacgacatattgcctttagacagtcgaaggggacgccttagctaggcactgaacgtttaggcgccagatgcgcgtcttgggatgaccataactcgcaggcttatcgatgatctactgcacgctcaccaaccaggtctttgatgcgcgcgcgatagactgacggatcgctacgaacatttaactcgctagtaacttaattgagatcctaggggatgggataggaaatagaatccacccctatcaccgcgcccacatagcctgcttggggtgttgagtttacttttatttcggttggaatgagttgaacttccgggaagtggagtaatgggtttgtctacttcccctaacgcaacagtactagttttacgagtggcgttgcaagccataggccagtcacaggtaataaacaattcaatcgtggcgtaaagattggccgcttgctgtgggcattgcaagctgggtttgcagcattgtgcatgctagacgacaatatgaatctgcgggacccctagtggccaagatggcgctagcggttccgcagcttttgacctggaccagggtgcatagcctgccagcctt

SEQ ID NO: 790691 - DNA, 719 bp, Homo sapiens
  misc_feature: 16918.UNK.UNK.UNK.pb.heavy.1.raw 16918
cgtatcgcctccctcgcgccatcagacagtatatacacgaccgggtgctcgatttagcagacgtctgaacacacaaaggggctgggagaggagccccagccgtgagattcccaggagtttccacttggtgatcagcactgagcacagaccaccaaccatggagtttgggctaatcttgattttccttgtagtttttttagaaggtgtccagtgcgagggggcgactggcggagtcgggggggggcttggcacagccagggcggtctctgagactctcctgtgtagtctcaggattcagtctttttagtgattatcacttggcctgggtccgtcaggctccaggaaggggcttgagtggatcactttcgtcagaatgaaacgttatggtgggaagtaaaggagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccaggggacaatggtcacccgtcttcttcagcttccaccaagggcccatcggtctttccccctggcgccctgctccaggagcacctctggggcacagcggcctgggctgcctggtcaaggactacttcctatatactgtctgagcgggctggcaaaggcgcatag

SEQ ID NO: 790692 - DNA, 548 bp, Homo sapiens
  misc_feature: 16920.44.78.H01.1.pb.heavy.1.raw 16920
cgtatcgcctccctcgcgccatcagacagtatatacacgaccggtgctcgattagtgtgagtagtttgggttgggtgccgaagttgctggaggtcacggtcaccacgctgctgaggtgaagaagcctgggcctcagtgacagtctcctgcacggcttctggatacacgttcatcattatgatattaactgggtgcgacaggccgctggacaaggctggagtggatgggatggatgaagccctatagtggcaacacgggctttgccagaagttcaaggcagagttagtatgacaggagcacctcccaggtacagtctacatggaactgagcagcctgagatctgaggacacggccgtgtatttctgtgcgagagccaccagcacctggcttgacttgtgggccaggaaccctggtcaccgtctctcagcctcaccaagggcccatcggtcttcccctggcgccctgctccaggagcacctccgagagcacagcgccctgggctgcctggtcaaggactacttcctatatactgtctgagcgggctggca

SEQ ID NO: 790693 - DNA, 706 bp, Homo sapiens
  misc_feature: 16957.44.36.D03.1.pb.heavy.1.raw 16957
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctccctgtgtcgcctctggattcaccatcagtgaccactatatggactgggtccgccccaggctccagggaaggggctggagtggcttggccgcagtaaaaacaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790694 - DNA, 705 bp, Homo sapiens
  misc_feature: 16969.UNK.UNK.UNK.pb.heavy.1.raw 16969
cgtatcgcctccctcgcgccattcagacagtatatacacgaccggtgctcgattttggatctactgacaaccaacattcctcctctaaagaagcccctgggagcacagcttcatcaccatggaactggacctggaggttcctctttgtggtggcagcagcaacaggtgtccagtccctggtgcaaactggttggcagtctgggactagaatgccgcaaccttggtcctccgtgacccttttcctgcaacggcctctggaagtactaccagttccactacttataccatcaaactgggtgcgccaggcccctggacagggcttgagtggatgggtggaatcatccctctttttggctcactcaccacgcacgagactttcggggcagaattacgattaccgccggacaagtcacagaacacagttctccatgaacaaatgagttctttgaaaatccgacgacacggccgtctacttactgttgcgagaggtccgtaccccagctcgcatggagcctttgaaagattctgggggccagggaaaccctggtcattgttcacctcagccttcccaccaaggggcccatcggtctttccccctggcgccctgctccagggagcacctctgggggcacagcggccctggctggccctggtcaaggactacttcctatatacctgtctgagcgggctggcaaaggcgcatag

SEQ ID NO: 790695 - DNA, 708 bp, Homo sapiens
  misc_feature: 16978.44.27.C05.1.pb.heavy.1.raw 16978
cgtatcgcctccctcgcgccatcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctgggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgccgagactatctgtttcccaaaatcggtttcattcgacgcctgggccagggaaccctggtcaccgtctcctcggcctccaccaagggcccatcggtcttccccctggcgccctgctccaggagcacctccgagagcacagcggccctgggctgcctggtcaaggactacttcctatatactggtctgagcgggctggcaaggcgcatag

SEQ ID NO: 790696 - DNA, 652 bp, Homo sapiens
  misc_feature: 16979.44.86.H09.1.pb.heavy.1.raw 16979
cgtatcgcctccctcggcgccatcagacagtatatacacgaccggtgctcgatttagtgctatagacttggtttggggatgctttctgagagtcaaggacctcctgtgcaagaacatgaagcacctgtgggtttttcctcctgctggtgcagctcccagatgggttcctgtccagtggcagcctgcaggatcggcccaggactggtgaggcctttcgggaaccctgtctctcatctgcactgtctctggagtttccatcagttctgatcattcttgggggctgatcgcgcagcccccagggaggggaatggagtggattggtgacatccattatactggggcgacgtactactctccgtccctcaagagtcgtctcaccatttcgagggacacgtcatgaccgcttctcctgaaaaactgacctccgtgaccgccgcggacacggccgtttatttctgtgcgaggcgagactggtctttcaatctatgggccgtgcaccctggtcactgtctcctcagcttccaccaagggcccatttggtcttccccctggcgccctgctccaggagcacctctgggcacagcggccctgggctgcctggtcaaggactactttcctatatactgtctgagcgggctggcaaggcgcatag

SEQ ID NO: 790697 - DNA, 720 bp, Homo sapiens
  misc_feature: 16992.UNK.UNK.UNK.pb.heavy.1.raw 16992
ctatgcgccttgccagcccgctcagacagtatataggaagtagtccttgaccaggcagcccagggccgctgtggctctcggaggtgctcctggagcaggggcgccaggggggaagaccggatgggccttggtggacggctgaggagacggtgaccagggttccccgggccccagtagtcaaaaccagccactgaccaagtggcccgatctctcgaacagaagtagacagccgtgtcctcgtcctcaggctgttcatttccagatacagtgagttctggcattgtccctggaattggtgaatcggccccttcacagagtctgcgtagtaggtggtatctccagcaatattaacatatgaaaccactccagcccttccctggagccctggcggacccagttcatggcatagtcactgaagatggaatccagaggctggcacaggagaggtctcaggacgaccccccccgctgtaccaagcctcccccagactccaccagccgcacctcacagtggacaccttctaaaatagcaacaaggaaaacccagcgcagccccaactccatggtgagtcctctgtgttcagtgctgatcaccaagtggaaatgccttggaatccagggctaaggcacctctctgagagctcccaagagagatcgtgacgcagctaaatcgaggcaccggtcgtgtatatactgtctgatggcgcgaggaggcgatacg

SEQ ID NO: 790698 - DNA, 712 bp, Homo sapiens
  misc_feature: 17001.UNK.UNK.UNK.pb.heavy.1.raw 17001
ctatgcgccttgcccagcccgctcagacagtatatataggaagtagtccttgaccaggcagcccagggccgctgtgctctcgggaggtgctcctggagcagggcgccagggggaagaccgatgggcccttggtggaggctgaggagacggtgaccagggttccctggcccagtggacagttcctgatataaacacaacacaataatacatgcccgtgtcctcggttttcaggttagtcattcgcagaatcaatgagttcttgaagtcatctcttgagagggtgaatctggcttcacagacgcggcgtactctgtgataaagctggcaactttgttttttactgcggccaagccactccagccccgttccctggaggcctggcggaccccagtccatatagtggtcactgatggtgaatccagaggcgacacaggagagttctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaaacacctgggaattctggggctggggctccgctctcagagctcccaagagagatcgtgacgcagctaatcgagcacccggtcgtgtatatactgtctgatggcgcgagggaggcgatacg

SEQ ID NO: 790699 - DNA, 691 bp, Homo sapiens
  misc_feature: 17002.44.74.G08.1.pb.heavy.1.raw 17002
cgtatcgcctccctcgcgccatcagacagtatatacacgaccggtgctcgatttagtagctctatcagggggagcatcacataacaaccacattcctcctctaaagaagcccccgggagcacagctcatcaccatggactgacctggaggttcctctttgtggtggcagcagcaacaggtgtccagtcctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcacctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 790700 - DNA, 727 bp, Homo sapiens
  misc_feature: 17015.UNK.UNK.UNK.pb.heavy.1.raw 17015
cgtatcgcctccctcgcgccattcagacagtatataccgcgaccggtgctcgatttagtaatcactcagtcgcggggagctctgggagaggagcccagcactagaagttcggcggtgtttccattcggtgatcagcactgaaacacagaggactcaccatggagtttgggctgagctggggttttcctcgttgctcttttaagaggtgtccagtgtcaggtgcagctggtggagtctgggggaggcgtgtccagcctgggagggtccctgagactctcctgtgcagcgttctggattcaccttcagtacctatggcatgcactggtccgccaggctccaggcaaggggctggagtgggtggcattatatggtatgatggaagtaataaatactatgcagactccgtgaagggccgattcaccatctcagagacaattccaagaacacgctgtatctgcaaatgaacagcctgagagccgagacacggctgtgtattactgtgcgaggacatattgtagtactaccacctgctgggactactactacggtatggacgtctggggccaagggaccacggtcaccggtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 790701 - DNA, 676 bp, Homo sapiens
  misc_feature: 17018.44.35.D02.1.pb.heavy.1.raw 17018
ctatgcgccttgccagcccgctcagacagtatataggaagtagtccttgaccaggcagccagggccgctgtgccccagaggtgctcttggaggagggtgccagggggaagaccgatgggcccttggtggaggctgaggagacggtgaccagggttccctggccccaggggtcgagccagttcgcccccccgtctctactgtatcgataggaatctctcgcacaataatatacggccgtgtccgcggcggtcacagaagtcaatttcagggagaactggttcttggacctgtctagtgacatggtgactcgactcttgagggcgggttgtagttggtgctgccactgttatagatgcgcccaatccactccagtcccttcccggcggactgccgcagccaactccaataataactactgatgtaaccaccagagacattgcaggtgagggacagggtctccgaaggcttcacccgtcctgggcccgactcctgcagctgcacctcggacacgacccatctgggaggtgcccaccaggaggaggaagaaccacaggtgtttcatgttcttgtgcaggaggcccatgagtctcagaaagtatccccaaacccaactatcgtgtgctaaatcgagcaccggtcgtgtatatactgtctgatggcgcgaggaggcgatacg

SEQ ID NO: 790702 - DNA, 695 bp, Homo sapiens
  misc_feature: 17032.44.55.E11.1.pb.heavy.1.raw 17032
ctatgcgccttgccagcccgctcagacagtatataggaagtagtccttgaccaggcagccaggccgctgtgccccagaggtgctcttggaggagggtgccaggggaagaccgatgggcccttggtggaggcggaggcgacggtgaccagggttccctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagccagaggctgcacaggagagtctctgggacccccaggctggactagcctcctccagactcatcagccgcacctcacactggacaccttttaaagtccaacaaggagaacccagctcagccaaaactccatggtgagtcctctgtgttcagtgctgatcaccgaatggaaacacctcggaatcccagtgctgggctcctctccccccaaacccaacgtgcgagtgctaaatcgagcaccggtcgtgtatatactgtctgatggcgcgagggaggcgatacg

SEQ ID NO: 790703 - DNA, 596 bp, Homo sapiens
  misc_feature: 17076.UNK.UNK.UNK.pb.heavy.1.raw 17076
ccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacggatcgctacagacatttaactcgctagtaacttaattgagatcctagggatggataggaaatagaatccaccctatcaccccccacatagcctgcttggggtgttgagtttacttttatttcgtgttggaatgagttgaacttccgggaagtggagtaatgggtttgtctacttccctaaccgcaaagtactagttttacgagtggcgttgcaagccatagccagtcacaggtaataaacaattcaacgtggcgtaaagattgccgcttgctgtgggcattgcaagctgggtttgcagcattgtgcatgctagacgacaatatgaatctgcgggacccctagtggccaagatggcgctagcggttccgcagctttgacctggaccagggtgcatagcctgccagccttc

SEQ ID NO: 790704 - DNA, 733 bp, Homo sapiens
  misc_feature: 17102.UNK.UNK.UNK.pb.heavy.1.raw 17102
ctatgcgccttgccagccccgctcagacagtatataggaagtagtccttgaccaggcagcccagggccgctgtgcccccagaggtgctcttggaggagggttgccaggggggaagaccgatgggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcggttcttggaattgtctctggagatggtgaatcggcccttcacgggagtctgcatagtatttattacttccatcataccatataagtgccaccactccaggcccttgcctggagcctggcggacccagtgcatgccataggtactgaaggtgaatccagacgctgcacaggagagtctcagggacctcccccagctggacacgcctcccccagaactccaccagctgccacctgacaactgggacacctcttaaaagacaacgaggaaaacccagctcagcccaaactccatggtgagtcctctgtgttcagtgctgatcaccgaatggaaacacccgccgacttctagtgctgggcctcctctcccagagctcccccgcgactgagtgatactaaatcgaagcaccgtcgtcgtatatactgtctgatgggcgcgagggaggcgatacg

SEQ ID NO: 790705 - DNA, 683 bp, Homo sapiens
  misc_feature: 17130.44.53.E09.1.pb.heavy.1.raw 17130
cgtatcgcctccctcgcgccatcagacagtatatacacgaccggtgctcgatttagagagagtgtgttgagctctgggagaggagcccagccttgggattcccaggtgttttcattcagtgatcaggactgaacacagaggactcaccatggagtttgggctgagctggattttccttgctgcctattttaaaaggtgtccagtgtgaggtgcagttggtggagtctgggggaggtttggtaaagcctgggagtcccttagactctcctgtgcagcctctggattcactttcagtaacggcctggatgacctgggtccgccaggctccagggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaaggggcccatcggtcttcccctggcgccctgctccaggagcacctccgagagcacagcgggccctggctgcctggtcaaggactacttcctatatactgtctgagcgggctggcaaggcggcata

SEQ ID NO: 790706 - DNA, 666 bp, Homo sapiens
  misc_feature: 17162.44.12.B01.1.pb.heavy.1.raw 17162
cgtatcgcctccctcgcgccatcagacagtatatacacgaccggtgctcgatttagtagtgtagattccgcggggctttctgagagtcatggaccttcctgtgcaagaacatgaagcacctgtggttcttcctcctgctggtggcggctcccagatgggtccctgtcccagctgcagctgcaggagtcggcccaggactggtgaagccttcggagaccctgtccctcacctgcactgtctctggtggctccatcagcagtagtagttactactgggctggatcgccagcccccagggaagggctggagtggattgggagtatctattatagtgggagcacctactacaacccgtccctcaagagtcgagtcaccatatcagtagacacgtccaagaaccagttctccctgaagctgagctcctgtgaccgccgcggacacggccgtgtattactgtgcggagagtagggcagttcgtcaccaactactttgaccactggggccagggaaccctggtcaccgtctcctcagcctccacaaggcccatcggtcttccccctggcaccctcctccaaggagcactctggggggcaacagcggccctggggctgcctggtcaagggactacttcctatatactgtctgagcgggctggcaaggcgcatag

SEQ ID NO: 790707 - DNA, 686 bp, Homo sapiens
  misc_feature: 17171.44.35.D02.1.pb.heavy.1.raw 17171
cgtatcgcctccctcgcgccatcagacagtatatacacgaccggtgctcgatttagcacacgatagttgggtttggggatactttctgagactcatgggcctcctgccacaagaacatgaaacacctgtggttcttcctcctcctggtggcacctcccagatgggtcgtgtccgaggtgcagctgcaggagtcggggcccaggacgcggtgaagccttcggagaccctgtccccacctgccaatgtctctggtggtttacatcagtagttattattggagttggctgcggcagtccgccgggaagggactggagtgggatgggcgcatctataacagtggcagcgccaccaactacaacccccggcctcaagagtcgagtcacccatgtcactagacaggtccaagaaccagttctccctgaaattgacttctgtgaccgccgcggacacggcgtatattattgtgcgagagattcctatcgatacagtagagacggggggggcgaactggctcgacccctgggccagggaaccctggtcaccgtctcctcaggcctccaccaagggcccatcggtcttcccctggcaccctccccaagagcacctctgggcacagcggccctgggctgcctggtcaaggactacttcctatatacttgtctgagcggggctggcaaggcgcatag

SEQ ID NO: 790708 - DNA, 702 bp, Homo sapiens
  misc_feature: 17194.UNK.UNK.UNK.pb.heavy.1.raw 17194
cgtatcgcctccctcgcgccatcagacagtatatacacgacggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataatttggaatatgcagtgggtccgccaggctccaggcgaggggctggagtgggtggcaggtgtgtcatttcatggaggaatcaagtctacggtgattccgttgagggccgattcaccatctccagagacaattccgagaacacagtgtctcttcaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790709 - DNA, 693 bp, Homo sapiens
  misc_feature: 17231.44.27.C05.1.pb.heavy.1.raw 17231
cgtatcgcctccctcgcgccatcagacagtatatacacgaccggtgctcgatttagacgcgatcgaagggtttggggcctgggagacgagccagcactggaagtcgccggtgtttcactcggtgatcatcactgaacacagaggactcaccatggagtttggctgagctgggttttcctcgttgccctcttaagaggtgtcatgtgtcaggtgcaattcgtggagtctggggaggcgtggccccagtagggggtccctgagactctcctgtgcagcctctggattcacctctcgataattggaatatgcagtgggtccgccaggctccaggcgaggggctgagtgggtggcagtgtgtcatttcatggaggaaacaagtctacggtgattccgttgaggccgattcaccatctccagagacaattccgagaacacagtgtctcttcaaatgaacagcctgagacctcaggacacggccgtgtatttttgtgcgagactatctgtttccaaatcggttcattcgacgcctggggccagggaaccctggtcaccgtctcctcggcctcaccaagggcccatcggtcttccccctgcgccctgctccaggagcactccgagagcacagcggccctgggctgcctggtcaaggactactttctatatactgtctgagcgggctggcaaggcgcatag

SEQ ID NO: 790710 - DNA, 708 bp, Homo sapiens
  misc_feature: 17234.UNK.UNK.UNK.pb.heavy.1.raw 17234
ctatgcgccttgccagcccgctcagacagtatataggaagtagtccttgaccaggcagcccagggccgctgtgctctcgaggtgctcctggagcagggcgccagggggaagaccgatgggcccttggtggaggctgaggagacggtgaccagggttccccggccccagtagtcaaaccagccactgaccaagtggcccgatctctcgaacagaagtagacagccgtgtcctcgtctctcaggctgttcatttccagatacagtgagttcttggcattgtccctggaattggtgaatcggcccttcacagagtctgcgtagtaggtggtatctccagcaatattaacatatgaaacccactccagccccttccctggagcctggcggacccagttcatggcatagtcactgaagatgaatccagaggctgcacaggagagtctcaggacccccccgctgtaccaagcctcccccagactccaccagccgcacctcacagtggacaccttctaaaatagcaacaggaaaacccagcgcagccccaactccatggtgagtcctctgtgttcagtgctgatcaccaagtggaaatgccttggaatccagggctaaggcacctctctgagagctcccaagagagatcgtgacgcaggcctaaatcgagcaccggtcgtgtatatactgtctgatggcgcgaggaggcgatacg

SEQ ID NO: 790711 - DNA, 651 bp, Homo sapiens
  misc_feature: 17248.44.86.H09.1.pb.heavy.1.raw 17248
atgcgccttgcagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 790712 - DNA, 681 bp, Homo sapiens
  misc_feature: 17259.44.36.D03.1.pb.heavy.1.raw 17259
cgtatcgcctcctcgcgccatcagacagtatatacacgaccggtgctcgattagctgcgtcacgatctctcttgggggagagcggagcccagcccagaattcccaggtgttttcattgtgatcagcactgaacacagaggactcaccatggagttcgggctgagctgggtttccttgttgttattttacaaggtgtccagagtgaagtgcagttggtggagtcgggggagacttggtccagcctggagggtcctgagactctcctgtgtcgcctctggattcaccatcagtgaccactatatggactgggtccgccaggctccaggaagggctggagtggcttgccgcagtaaaaacaaagttgccagctttatcacagagtacgccgcgtctgtgaaagccagattcaccctctcaagagatgacttcaagaactcattgattctgcgaatgactaacctgaaaccgaggacacggcatgtattattgtgttgtgtttatatcaggaactgtccactgggccagggaaccctggtcaccgtctcctcagcctccaccaagggccatcggtcttcccctggcgccctgctccaggagcacctccgagagcacagcggccctggctgcctggtcaaggactacttcctatatactgtctgagcgggctggcaaggcgcatag

SEQ ID NO: 790713 - DNA, 672 bp, Homo sapiens
  misc_feature: 17284.44.6.A06.1.pb.heavy.1.raw 17284
cgtatcgcctccctcgcgccatcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctggggcagggaaccctggtcattgtcacctcagcttccaccaagggcccatcggtcttccccctggcgccctgctccaggagcacctctgggggcacagcggccctgggctgcctggtcaaggactacttcctatatactgtctgagcgggctggcaaggcgcat

SEQ ID NO: 790714 - DNA, 698 bp, Homo sapiens
  misc_feature: 17305.UNK.UNK.UNK.pb.heavy.1.raw 17305
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagaccactccagccccttccctggagcctggcggacccaactcatgtagttgctgctgacggtgagcccagaggctgcacaggagagtctctgggacccccccaggctggactaagcctcctccagactccatcagccgcacctcacactggacaccttttaaaagtccaacaaggagacccagctcagccaaaactccatggtgagtctctgtgttcagtgctgatcaccgaatggaaacacctcggaatcccagtgctggctcctctccccaaacccaacgtgcgagtgctaaatcgagcaccggtctgtatatactgtctgatgcgcgagggaggcgatacg

SEQ ID NO: 790715 - DNA, 727 bp, Homo sapiens
  misc_feature: 17313.44.85.H08.1.pb.heavy.1.raw 17313
cgtatcgcctccctcgcgccatcagacagtatatacacgaccggtgctcgatttagtatcactcagtcgcggggagctctgggagaggagcccagcactagaagtcggcggtgtttccattcggtgatcagcactgaacacagaggactcaccatggagtttggggctgagctgggtttttcctcgttgctcttttaagaggtgtccagtgtcaggtgcagctggtggagtctgggggaggcgtggtcccagcctgggaggtccctgagactctcctgtgcaagcgtctggattcaccttcagtacctatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 790716 - DNA, 722 bp, Homo sapiens
  misc_feature: 17324.UNK.UNK.UNK.pb.heavy.1.raw 17324
ctatgcgccatgcccagccgctcagacaggtatataatggaagtagtccttgaccaggcagcccagggccgctgtgctctcggaggtgctcctggagcaggggcgccagcggggaagaccgatgggcccttggtggaggctgaggagagcggtgaccagggttccctggcccccagtgacagttcctgatataaacacaacacataaatactatgcggccgtgtcgtcggttttcaggttgtcattcgcagaatcaatgagttctttgaagtcatctttcttgagagggtgaatctggctttcacagacgcgggcgtactctgtgataaagctggcactcttgttttactgcggccaagccactccagccccttccctggacccctggcgagccagtcccataatacgtggtcactgatggtgaatccagaggcgcgacacagagagtctcagggaccctccaggctggaccaagtctccccccggactccaccaactgcaccttcactctggacaccttgtaaaataacacaaggaaaacccagctcagcccgaactccatggtgagtcctctgtgttcagtgctgatcaccaatgaaaacacctgggaattctggggctggggctccgctctcagagctccccaagagagatcgtgacgcagctaataatcgagcaccggtcgtgtatatactgtctgatggcgcgagggaggcgatacg

SEQ ID NO: 790717 - DNA, 697 bp, Homo sapiens
  misc_feature: 17337.44.27.C05.1.pb.heavy.1.raw 17337
ctatgcgccttgccagcccgctcagacagtatataggaagtagtccttgaccaggcagcccagggccgctgtgctctcggaggtgctcctggagcagggcgccagggggaagaccgatgggcccttggtggaggcgaggagacggtgaccagggttcctggcccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacgaatcaccgtagacttgatttcctccatgaaatgacacacctgccaccactccagccctcgcctggagcctggcggacccactgcatattccaattatcgaagtgaatccagaggctgcacaggagagtctcagggacccccctactgggccacgcctccccagactccacgaattgcacctgacacatgacacctcttaagagggcaacgaggaaaacccagctcagccaaactccatggtgagtcctctgtgttcagtgatgatcaccgagtggaaacaccggcgacttccagtgctgggctcgtctcccagggctccccaaacccttcgatcgcgtctaaatcgagcaccggtcgtgtatatactgtctgatggcgcgaggaggcgatacg

SEQ ID NO: 790718 - DNA, 681 bp, Homo sapiens
  misc_feature: 17339.UNK.UNK.UNK.pb.heavy.1.raw 17339
ctatgcgccttgccagccgctcagacagtatatagaagtagtccttgacaggcagccagggccgctgtgctctcggaggtgctcctggagcagggcgccaggggaagaccgatgggcccttggtggaggctgaggagacggtgaccagggttccctggcccagtggacagttcctgatataaacacaacacaataatactgcccgtgtcctcggtttcaggttagtcattcgcagaatcaatgagttcttgaagtcatctcttgagagggtgaatctgcttcacagacgcgcgtactctgtgataaagctggcaactttgtttttactgcggccagccactcagccccttccctggagcctggcggacccagtccatatagtggtcactgatggtgatccagaggcgacacaggagagtctcagggaccctccaggctgaccaagtctccccggactccaccaactgcacttcactctggacaccttgtaaaataacaacaagaaaacccagctcagccgaactcatggtgagtcctctgtgttcagtgctgatcaccaaatgaaacacctggaattctgggctggggctccgctctcagagctccccagagagatcgtgacgcagtaaatcgagcaccggtcgtgtatatactgtctgatggcgcgagggaggcgatacg

SEQ ID NO: 790719 - DNA, 638 bp, Homo sapiens
  misc_feature: 17342.UNK.UNK.UNK.pb.heavy.1.raw 17342
cgtatcgcctccccgcgccatcagacagtataccacgacggtgctcgatttagcacacgatagttgggtttgggatactttctgagaccatgggcctcctgcacaagaacatgaaacacctgtggttctcctcctggtggcacctcccgatgcgtgtccgagtgcagctgcaggtcgggccaggacgggtgaagccttcggagaccctgtccctcacctgcaatgtctctggtggttacatcagtagttattattggagtggctgcggcagtccgccggaagggactggagtggattgggcgcatctataacagtggcagcacactcacccgccctcaaggtcgagtcaccatgtcactagacaggtccaagaaccagttctcctgaattgacttctgtgaccgccgcgggacacggccgtatattattgtgcgagagattcctatcgatacgtagagacgggggggcgaactggctcgaccctggccagggaacctggtcaccgtctcctcagctccaccagggcccatcggtcttcccctggcacctctccagagcacctctggggcacagcggcctggctgcctggtcaaggattacttcctatatactgtctgagcggctggcaaggcgcatag

SEQ ID NO: 790720 - DNA, 718 bp, Homo sapiens
  misc_feature: 17389.UNK.UNK.UNK.pb.heavy.1.raw 17389
tcgtatcggcctccctcgcgccccctcggccatcagacaggtatatacacgcgacggtgctcgattagtagctctatcaggggggagcatcacataacaaaccacattcctcctctaaagaagcccctgggagcacagctcatcaccatggactggacctggaggttcctctttgtggtggcagcagcaacaggtggtccagtcccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccgggccagaattacgataccgcgcgacaagtccacagacacagtctccatgacaatgagtttctttgaaatccgacgacaccgggccggtctactactgtgcgagaggtccgtaccccagctcgcatggagcctttgagatctggggccagggaaacctggtcattgtcacctcagctttccaccaagggcccatccggtcttccccctggcgccctgctccaggagcacctctgggggcacagcggcctgggctgcctggtcaaggactacttcctatatactgtctgagcggggctggcgcaaggcgcatag

SEQ ID NO: 790721 - DNA, 709 bp, Homo sapiens
  misc_feature: 17454.44.27.C05.1.pb.heavy.1.raw 17454
ctatgcgccttgccagcccgctcagacagtatataggaagtagtccttgaccaggcagcccaggggccgctgtggctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgatcggccctcaacggaatcaccgtagacttgatttcctcccatgaaatgacacacctgccacccactccagcccctcgcctggagcctggcggacccactgcatattccaattatcgaaggtgaatccagaggctgcacaggagagtctcagggacccccctactgggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagggctccccaaacccttcgatcgcgtctaaatcgagcaccggtcgtgtatatactgtctgatggcgcgagggaggcgatacg

SEQ ID NO: 790722 - DNA, 616 bp, Homo sapiens
  misc_feature: 17465.UNK.UNK.UNK.pb.heavy.1.raw 17465
gaaggctgggcaggctatgccaccctggtccaggtcaaaagctgcggaacccgctagcggccatcttggccactaggggtccgcagattcatattgtcgtctagcatgcacaatgctgcaaacccagcttgcaatgccacagcaagcgggccaatctttacgccacgttgaattgtttatttacctgtgactggctatggtctgcaacgccactcgtaaaactagtactttgcggtttaggggaagtagacaaacccattactccacttccggaagttcaactcattccaacacgaaataaaagtaaactcaacacccaagcaggctatgtggggcggtgataggggtggattctgatttcctatcccatcccctaggatctcaattaagttactagcgagttaaaatgtctgtagcgatcccgtcagtcctatcgcgcgcatcaagacctggtggtttgagccgtgcagtagatcatcgataagctgcgagttaggtcatcccagaccgcatctggcgcctaaacgttcagtgtagctaaggcgtccttcaccttcgactgtctaaaggcacatatgtcgtcctttagctccaagtcctagcaagcgtgcgtcgg

SEQ ID NO: 790723 - DNA, 692 bp, Homo sapiens
  misc_feature: 17473.UNK.UNK.UNK.pb.heavy.1.raw 17473
ctatgcgccttgccagcccgctcagacagtatataggaagtagtcttgaccaggcagcccagggccgctgtgctctccggaggtgctcctggagcagggcgccagggggaagaccgatgggcccttggtggaggccgaggagacggtgaccagggttccctggccccaggcgtcgaatgaaccgattttggaagcagatagtctcgcacaaaaatacacggccgtgtcctgaggtctcaggctgttcatttgaagagacactgtgttctcggaattgtctctggagatggtgaatcggccctcaacggaatccaccgtagacttgattttccccatgaaatgacacaccctgccacccactccagcccctcgcctggagcctggcggacccactgcatattccaattatcgaaggtgaatcagaggctgcacaggagagtctcaggacccccctactggggcacgcctccccagactccacgaattgcacctgacacatgacacctcttaagagggcaacgaggaaaaacccagctcagcccaaaactccatggtggagtcctctgtgttcagtgatgatcaccgagtggaaacaccggcgacttcctcttccccccaaacccttcgatcggcgtctaaatcgagcacgcgtcgtgtatatactggtctgatggcgcgagggaggcgatacg

SEQ ID NO: 790724 - DNA, 695 bp, Homo sapiens
  misc_feature: 17475.44.73.G07.1.pb.heavy.1.raw 17475
ctatgcgccttgccagcccgctcagacagtatataggaagtagtccttgaccaggcagccagggcgctgtgctctcggaggtgctcctggagcagggcgccagggggaagaccgatggcccttggtggaggctgaggagaccggtgaccagtgtcccctggcccagtgaaacgcccgataatagctgctgccacttcccgatctcgcacagtaatacagagccgagtcctcgcctctcaggctgatcatttccaggtacagagtgttccgggaattgtctctggagatggtgaatcgccccttcacggagtctgcataatatctagaagttccatcatatgctataactgccaaaccactccggcccttgcctggagcctggcggacccagtgcatgccagaactactgaaactaatccagaggcttcacaggagagtctcagggacctcccaggctggaccacgcctccccagactccaccaggtgcacctgacactggacacctcttaaagagtaacgaggaaaacccagctcagcccaaactccatggtgagtcctctgtgttcagtctgatcaccgaatggaaacaccgccgactctagtgctggctcctctcccagagctcccctgagcgtagagctaaatcgagcaccggtcgtgtatatactgtctgatggcgcgaggaggcgatacg

SEQ ID NO: 790725 - DNA, 721 bp, Homo sapiens
  misc_feature: 17506.44.85.H08.1.pb.heavy.1.raw 17506
cgtatcgcctccctcgcgccatcagacagtatatacacgaccggtgctcgatttagtatcactcagtcgcggggagctctgggagaggagccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaagggcccatcggtcttcccctggcaccctcctccaagagcacctctgggggcacagcggccctgggctgcctggtcaaggactacttcctatatactgtctgagcgggctggcaaggcgcatag

SEQ ID NO: 790726 - DNA, 698 bp, Homo sapiens
  misc_feature: 17511.44.36.D03.1.pb.heavy.1.raw 17511
ctatgcgccttgccagcccgctcagacagtatataggaagtagtccttgaccaggcagccagggccgctgtgctctcgaggtgctcctggagcagggcgccaggggaagaccgatgggcccttggtggaggctgaggagacggtgaccagggttccctggccccagtggacagttcctgatataaacacaacacaataatacatgccgtgtcctcggtttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggaccagtccatatagtggtcactgatggtgaatccagaggcgacacaggagagtctcagggaccctccaggctggaccaagtctcccccggactccaccaactgcacttcactctggacaccttgtaaataacaacaaggaaaacccagctcagcccgaactccatggtgagtcctctgtgttcagtgctgatcaccaaatgaaaacacctgggaattctggggctggggctccgctctcagagctcccaagagagatcgtgacgcagctaaatcgagcaccggtcgtgtatatactgtctgatggcgcgaggaggcgatacg

SEQ ID NO: 790727 - DNA, 670 bp, Homo sapiens
  misc_feature: 17515.44.6.A06.1.pb.heavy.1.raw 17515
ctatgcgccttgccagcccgctcagacagtatataggaagtagtccttgaccaggcagcccagggccgctgtgcccccagaggtgctcctggagcagggcgccagggggaagacgatgggcccttggtggaagctgaggtgacaatgaccagggttccctgccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgcccggaagtctcgtgcgtaggtgagtgagccaaaaagagggatgattccacccatccactcaagcccttgtccaggggcctggcgcacccagttgatggtataagtagtggaactggtagtacttccagaggccgtgcaggaaagggtcaccgaggaccaaggttgcggcattctagtccagactgcaccagttgcaccagggactggacacctgttgctgctgccaccacaaagaggaacctccaggtccagtccatggtgatgagctgtgctccaggggcttctttagaggaggaatgtggttgtcagtagatctaaatcgagcaccggtcgtgtatatactgtctgatggcgcgagggaggcgatacg

SEQ ID NO: 790728 - DNA, 604 bp, Homo sapiens
  misc_feature: 17520.UNK.UNK.UNK.pb.heavy.1.raw 17520
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttagggaagtagacaaacccattactccacttccggaagttcaactcattccaacacgaaataaaagtaaactcaacaccccaagcaggctatgtgggggggtgataggggtggattctatttcctatccatccctagggatctcaattaagttactagcgagttaaatgtcctgtagcgatcccgtcagtcctatcgcgcgcatcaagacctggtggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcgg

SEQ ID NO: 790729 - DNA, 702 bp, Homo sapiens
  misc_feature: 17522.44.27.C05.1.pb.heavy.1.raw 17522
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgatttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaacaccggcgacttccagtgctggctcgtctcccagccccaaacccttcgatcgcgtctaaatcgagcaccggtcgtgtatatactgtctgatggcgccgagggaggcgatacg

SEQ ID NO: 790730 - DNA, 716 bp, Homo sapiens
  misc_feature: 17544.44.55.E11.1.pb.heavy.1.raw 17544
ctatgcgccttgccagcccgctcagacagtatataggaagtagtccttgaccaggcagcccagggccgctgtgcccccagaggttgctcttggaggagggtgccagggggaagaccgatgggcccttggtggaggcggaggcgacggtgaccagggttccctggccccagaagtcaaacgaataataaaccactccgagcgccgacttgtctcgcacagtaatagacggccgtgtcgtcgcctctcaggttgtttcattttgaagataaaccgtgtttcctggaattgtccctggagatggtgaatcggcccttcacggagtctgcgtagtatgtgaaatcaccagtataaatgactgagacccactccagcccctttccctggagcctggcggacccaactcatgtagttgctgcttgacggtgagcccagaggctgcacaggagagtctctgggaccccccaggctggactaagcctcctccagaactccatcagccgcacctcacactggacacctttttaaaaagtccaacaaggagaacccagctcagccaaactccatggtgagtcctctgtgttcagtgctgatcaccgaatggaaacacctcggaatcccagtgctgggctcctctcccccccaaacccaacgtgcgagtgctaaatcgagcaccggtcgtgtatattactgtctgatggcgcgagggaggcgatacg

SEQ ID NO: 790731 - DNA, 708 bp, Homo sapiens
  misc_feature: 17545.44.55.E11.1.pb.heavy.1.raw 17545
cgtatcgcctccctcgccgccatcaagtatatacacgaccggtgctcgatttagcactcgcacgttgggtttggggagaggagcccagcactgggattccgaggtgtttccattcggtgatcagcactgaacacagaggactccaccatggagttttggctgagctgggttctccttgttggacttttaaaaggtgtccagtgtgaggtgcggctgatggagtctggaggaggcttagtccagcctggggggtcccagagactctcctggtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatctcaatgaacaacctgagaggcgacgacacggccgtctattactgtgcgagacaagtcgggcgcctcggagtggttattattcgtttgacttctggggccagggaaccctggtcaccgtcgcctccgccctccaccaagggcccatcggtcttccccctggcaccctccctccaagaggcacctctggggggcacagcggccctgggctgcctggtcagaggactacttcctatatactgtctgagcgggctggcaaggcgcatag

SEQ ID NO: 790732 - DNA, 705 bp, Homo sapiens
  misc_feature: 17551.44.27.C05.1.pb.heavy.1.raw 17551
cgtatcgcctccctcgcgccatcagacagtatatacacgaccggtgctcgatttagacgcgatcgaagggtttggggctgggagacgagcccagccactggaagtcgccggtgtttccactcggtgatcatcactgaacacagaggacttcaccatgggagtttgggctgagctggggttttcctcgttgccctcttaagaggtgtcatgtgtcaggtgcaattcgtggagtctgggggaggcgtggccccagtaggggggtccctgagactctctgtgcagcctctggattcaccttcgataattggaatattgcagtggtccgccaggctccaggcgaggggctggagtgggtggcagtgtgtcatttcatggaggaaatcaagtctaacggtgattccgttgagggccgattcaccatctcagagacaattccgagaacacagtgtctcttcaaatgaacagcctgagacctcaggacacggccgtgtatttttgtgcgagactatctgtttccaaatcggttcattcgacgcctggggccagggaacccctggtcaccgtctcctcggcctccaccaagggccatcggtcttccccctggcgccctgctccaggagcacctccgagagcacagcggccctgggctgcctggtcaaggactacttcctatatactgtctgagcgggctggcaaggcgcatag

SEQ ID NO: 790733 - DNA, 721 bp, Homo sapiens
  misc_feature: 17554.UNK.UNK.UNK.pb.heavy.1.raw 17554
ctatggcgccttgccagcccgctcagacagtatattaggaagtagtccttgacaggcagcccaggccgctgtgcccccagagtgctcctgggagcagggcgcgccaggggggaagacgatggcccttgtggaagctgaagaggacggtgaccattgtccctgcgcccaaatatcaaatgcatcgacgtcccaggatcgcctggcgcagtaatagacgcctgtgtcgtcgggtctcaggttgctcatttgtaaatggcaaccactgttggagtcatcccttgagacggtgaatcttccccttcacagacgcgggcgtactctttacttccaccataacgtttcattctgacgaaagtgatccactcaagccccctttcctggagcctgacggaccccaggccaagtgataatcactaagactgaatcctgagactacacaggagagtctcagagacgccctggctgtgccaaggccccgccccgactccgccagtcgccccctcgcactggacaccttctaaaaaactacaaggaaaatcaagattagcccaaactccatgttggtggtctgtgctcagtgctgatcaccaagtggaaactcctgggaatctcacggctggggctctctccagagccttcccatttgtgtgttcagacgtctggctaaatcgaggcagcggtcgtgtatatactgtctgatggcgccagggaggccgatacg

SEQ ID NO: 790734 - DNA, 690 bp, Homo sapiens
  misc_feature: 17558.44.36.D03.1.pb.heavy.1.raw 17558
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcgtttcaggttagtcattcgcagaatcaatgagttcttgaagtcatctcttgagagggtgaatctggcttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactcaccaactgcacttcactctggacaccttgtaaaataacaacaggaaacccagccagcccgaactccatggtgagtcctctgtgttcagtgctgatcaccaaatgaaaacacctgggaattctggggctgggctccgctctccccaagagagatcgtgacgcagctaaatcgagcaccggtcgtgatagtatagactgatggcgcgagggaggcgatacg

SEQ ID NO: 790735 - DNA, 677 bp, Homo sapiens
  misc_feature: 17571.UNK.UNK.UNK.pb.heavy.1.raw 17571
cgtatcgcctccctcgcgccatcagacagtatatacacgaccgggggctcgattagtgagtcagtaaggggaaagggctgggagaggagcccagcactagaagtcggcggtgtttccattcggtgatcagcactgaacacagaggactcaccatggagtttgggctgagctgggttttcctcgttgctcttttagaggtgtccagtgtcagttcagctggtggagtctgggggaggcgtggtccagcctgggacgtccctgagactctcctgtgttgcgtccggactcagtttcagtgactctgccatgcactgggtccgccaggctccaggcaagggctggagtggggtggcagtcatctggtctgatggaagtaaagatatactatggaaactccgtgaagggccgattctccgtctccagagacaattccaagaacaccgtgtatctacaaatgaacaatttgagagccgaggactcggctctctattattgtacgagcccatcgttctactgccgggccagggagccctggtcccgtctcctcagctccaccaagggccatcgtcttccccctggcgccctgctccaggagcacctccgagagcacagcgccctggctgcctggtcaaggactacttcctatatactgtctgagcggctggcaaggcgcatag

SEQ ID NO: 790736 - DNA, 664 bp, Homo sapiens
  misc_feature: 17580.44.6.A06.1.pb.heavy.1.raw 17580
cgtatcgcctcctcgcgccatcagacagtatatacacgaccggtgctcgatttagatctactgacaaccacattcctcctctaaagaagccctgggagcacagctcatcaccatggactggacctggaggttcctctttgtggtggcagcagcaacaggtgtccagtccctggtgcaactggtgcagtctggactagaatgccgcaaccttggtcctcggtgaccctttcctgcacggcctctggaagtactaccagttccactacttataccatcaactgggtgcgccaggcccctggacaagggcttgagtggatggtggaatcatccctcttttggctcactcacctacgcacgagacttccgggcagaattacgattaccgcggacaagtccacagacacagtctccatgacaatgagttctttgaaatccgacgacacggccgtctactactgtgcgagaggtccgtaccccagctcgcatggagcctttgagatctggggcagggaccctggtcattgtcacctcagcttccaccaagggcccatcggtcttcccctggcgccctgctccaggagcacctctggggcacagcggcctgggctgcctggtcaaggactacttcctatatactgtctgagcgggctggcaaggcgcatag

SEQ ID NO: 790737 - DNA, 676 bp, Homo sapiens
  misc_feature: 17582.44.36.D03.1.pb.heavy.1.raw 17582
ctatgccccttgccagcccctcagacagtatataggaagtagtccttgacaggcagcccagggcgctggctctcggaggtgctcctggagcagggcgccagggaagacgatgggccttgtggaggctgaggagacggtgaccaggttcctggccccagtgacagttcctgatataaacacaacacaataataatgcccgtgtcccggtttcaggttagtcattcgcagaataatgagttcttgaagtatctcttgagagggtgaatctggctttcacagacgcggcgtactctgtgataagctggcaacttgttttttactgcggccagccactccagccccttcctgagcctggcggacccagtccatatagtgtccatgatggtgaaatccagaggcgacacaggagagtctcagggaaccctccagctggaccaagtctcccccggactcaccaactgcacttcactctggacaccttgtaaaataacaacaaggaaaacccagctcagcccgaactccatggtgagtcctctgtgttcagtgctgatcaccaaatgaaaacacctgggaattctggggctggggcctcgctctccccaagagagatcgtgacgcagctaaatcgagcaccggtcgtgtatatactgtctgatggcgcgagggaggcgatacg

SEQ ID NO: 790738 - DNA, 541 bp, Homo sapiens
  misc_feature: 17612.44.43.D10.1.pb.heavy.1.raw 17612
ctatgcgccttgccagccgctcagacagtatatagggaagtagtccttgaccaggcagcccaggccgctgtgcccccagaggtgctcctgagcagggcgccaggggaagaccgatgggcccttgtggaagctgaggagacggtgaccagggttccctggcccaggggtcgaaccacctccccgacgagctgctatactttcgggatctcgcacagtaatacacggccgtgtcctcagatctcaggctgctcagctccatgtaggctgtgtttatggaggtgttcctggtcatggtgactctgccctggaacttctgtgcatagcctgtgttaccactgttagggttcatccatcccatccactcaagcccttgtccagtggcctgtcgcaccagtgatatcataattggtgaaggtgtatccagaagccttgcaggagaccttcactgaggccccaggcttcttcacctcagccccttactgctagtctaatcgagcaccggtcgtgtatatactgtctgatggcgcgaggaggcgatacg

SEQ ID NO: 790739 - DNA, 705 bp, Homo sapiens
  misc_feature: 17637.44.36.D03.1.pb.heavy.1.raw 17637
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgcgcgtctgtgaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgcccctgctccaggagcacctccgagagcacagcggccctgggctgcctggtcaaggactacttcctatatactgtctgagcgggctggcaaggcgcatag

SEQ ID NO: 790740 - DNA, 662 bp, Homo sapiens
  misc_feature: 17650.44.86.H09.1.pb.heavy.1.raw 17650
ctatgcgccttgccagcccgctcagacagtatataggaagtagtccttgaccaggcagcccagggccgctgtggccccagaggtgctcctggagcagggcgccagggggaaacgacctgggcccttggtggaagctgaggagacagtgaccagggtgccacggcccgccccctttagatgagaagaccagtctcgcctcgcacagaaataaacggccgtgtccgcggcggtcacggaggtcagtttcagggagaagcgttcatggacgtgtcctcgaaatggtgagacgactcttgagggacggagagtagtacgtcgccccccagtataatggatggtcaccaatccacctccattcccctccctgggggctgccggatccagcccaagaatgatcagaactgatggaaactcgcagagacagtgcagatgagagacaggttcccgaaggcgcctcaccagtcctggccgactcctgcagctgcacctggacaggacccatctggagctgccaccagcaggaggaaaaaccacaggtgcttcatgttcttgcacaggaggtccttgactctcagaaagcatccccaacccaacgtctatagcactaaatcgagcaccggtcgtgtatatactgtctgatggcgcgcgggggaggcgatacg

SEQ ID NO: 790741 - DNA, 695 bp, Homo sapiens
  misc_feature: 17681.UNK.UNK.UNK.pb.heavy.1.raw 17681
cgttcgcctccctcgcgccatcagacagtatatacacgaccggtgctcgatttagacgcgacgaagggtttgggcctgggagacgagcccagcactgaagtcgcggtgtttccactcggtgatcatcactgaacacagaggactcaccatggagtttgggctgagctgggttttcctcgttgccctcttaagagtgtcatgtgtcaggtgcaattcgtggagtctgggggaggcgtggccccagtaggggggtccctgagactctcctgtgcagcctctggattcaccttcgataatggaatatgcagtgggtccgccaggctccaggcgaggggctggagtgggtggcaggtgtgtcatttcatggaggaaatcagtctacggtgattccgttgagggccgattcaccatctccagagacaattccgagaacacagtgtctcttcaaatgaacagcctgagacctcaggacacgccgtgtttttttgtgcgagactatctgtttccaaaatcggtttcattcgacgcctgggccaggaacctggtcaccgtctcctcggcctcaccaagggcccatcggtcttccccctggcgccctgctccaggagcacctccgagagcacagcggccctggcgctgcctggtcaaggactacttcctatatactgtctgagcggggctggcaaggcgcatag

SEQ ID NO: 790742 - DNA, 670 bp, Homo sapiens
  misc_feature: 17682.UNK.UNK.UNK.pb.heavy.1.raw 17682
ctatgcgcctgccagcccgctcagacagtatataggaagtagtccttgaccaggcagcccagggccgctgtgctctcggaggtgctcctggagcagggcgccaggggaagaccgatgggcccttggtggaggctgaggagaccggtgaccagggttccctggcccgaatgaaaccatcccagacagtatagacgctgtgtcctcggtgttcaggctgttcatctgcagagacaccgtatcttttgaatcatctctgagatggtgaatctgcctttcacgggtgcagcgtagtctgcgtcccaccgtcagctttggttctaatacggccacccactccagcccttcctggagcctggcggacccaggtcatccaggcgttactgaaaagtgaatccagaggctgcacaggagagtctaagggactccccaggctttaccaaacctccccagactccaccaactgcacctcacactggacaccttttaaaatagcagcaaggaaaatccagctcagcccaaactccatggtgagtcctctgtgttcagtcctgatcactgaatgaaaacacctgggaatccaaggctggggctcctctccagagctcaacacctctctctaaatcgagcacggtcgtgtatatactgtctgatggcgcgaggaggcgatacg

SEQ ID NO: 790743 - DNA, 708 bp, Homo sapiens
  misc_feature: 17730.44.36.D03.1.pb.heavy.1.raw 17730
ctatgcgccttgccagcccgctcagacagtatataggaagtagtcttgaccaggcagcccagggccgctgtgctctcggaggtgctcctggagcagggcgccagggggaagaccgatgggcccttggtggaggctgaggagacggtgaccagggttccctggccccagtggacagttcctgatataaacacccaacacaataatacatgcccgtgtcctcggttttcaggttagtcattcgcagaatcaatgagttcttgaagtcatctcttgagagggtgaatctggctttcacagacgcggcgtactctgtgataaagctgggcaactttgtttttactgcggccaagccactccagccccttccctggagcctggcggacccagtccatatagtggtcactgatggtgaatccagaggcgacacaggagagtctcagggaccctccaggctggaccaagtctccccggactccaccaactgcacttcactctggacaccttgtaaaataacaacaaggaaaacccagctcagcccgaactccatggtggagtcctctgtgttcagtgctgatcaccaaatgaaaacacctgggaattctggggctggggctccgctctcagagctccccaagagagatcgtgacgcagctaaatcgagcaccggtcgtgtatatactgtctgatggccgcgagggaggcgatacg

SEQ ID NO: 790744 - DNA, 669 bp, Homo sapiens
  misc_feature: 17748.UNK.UNK.UNK.pb.heavy.1.raw 17748
cgtatcgcctccctcgcgccatcagacagtatataccgacaccggtgctcgatttagtagtgtagattccgcgggggctttctgagagtcatggacctcctgtgcaagaacatgaagcacctgtggttcttcctcctgctggtggcggctcccagatgggtctgtcccagctgcagctgcaggagtcgggcccaggactggtgaagccttcggagaccctgtccctcacctgcactgtctctggtggctccatcagcagtagtagttactactgggctggatccgccagcccccagggaaggggctggagtggatgggagtatctattatagtgggagcacctactacaacccgtccctcaagagtcgagtccaccatatcagtagacacgtccaagaaccagttctccctgaagctgagctctgtggaaccgccgcggacacggccgtgtattactgtgcggagtagggcagttcgtcaccaactactttgaccactggggccagggaaccctgggggtcaccgtctcctcagcctccaccaagggcccatcggtcttccccctggcaccctcctccaagagcacctctggggcacagcggccctgggctgctggtcaaggactactttccttatattactgtctgagcgggctggcaaggcgcatag

SEQ ID NO: 790745 - DNA, 653 bp, Homo sapiens
  misc_feature: 17759.44.23.C01.1.pb.heavy.1.raw 17759
atgcgccttgccagcccgctcagacagtatataggaaagtagtccttgaccaggcagcccagggccgcctgtgcccccagaggtgctcctggagcagggcgccagggggaagaccgatgggcccttggtggaagctgaggagacagtgaccagggtgccacggccccatagattgaaagaccagtcctcgcctcgcacagaaataaaccggcgtgtccgcggcggtcacggaggtcagtttcagggagaagcggttcatggacgtgtccctcgaaatggtgagacgactcttgagggacggagagtagtacgtcgccccagtataatggatgtcacccaatccactcccattcccctccctggggctgccggatcagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagccccaatccctaatcacgtgtactaaatcgagcaccggtcgtgtatatactgtctgatggcgcgagggaggcgatacg

SEQ ID NO: 790746 - DNA, 663 bp, Homo sapiens
  misc_feature: 17789.44.12.B01.1.pb.heavy.1.raw 17789
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggccatcggtcttccccctggcaccctcctccaagagcacctctgggggcacagcggccctgggctgcctggtcaaggactacttcctatatactgtctgagcgggctggcaaggcgcatag

SEQ ID NO: 790747 - DNA, 710 bp, Homo sapiens
  misc_feature: 17790.44.55.E11.1.pb.heavy.1.raw 17790
cgtatcgcctccctcgcgccatcagacagtatatacacgaccggtgctcgatttagcactcgcacgttgggtttgggagaggagcccagcactgggattccggaggtgtttccattcggtgatcagcactgaacacagaggactcaccatggagttttggctgagctgggttctccttgttggacttttaaaaaggtgtccagtgtgaggtgcggctgatggagtcggcggaggaggcctagtccagcctggggggtcccagagactctcctgtgcagcctctgggctcacgtcagcagcaactacatgagttggggtcgccaggctccagggaagggggctggagtgggggtctcagtcatttatactggtgatttcacatactacgcagactccgtgaagggccgattcaccatctccagggacaattccaggaaccggtttatcttcaaatgaacaacctgagaggcggacgacacggccgtctattactgtgcgagacaagtcggcgctcggagtggttattattcgtttgacttctggggccagggaaccctggtcaccgtcgcctccgcctccaccaagggcccatcggtcttgccccctggcacctcctccaagagcacctctggggggcacagcggccctgggctgcctggtcaaggactacttcctatatactgtctgagcggggctggcaaggcgcatag

SEQ ID NO: 790748 - DNA, 702 bp, Homo sapiens
  misc_feature: 17804.44.27.C05.1.pb.heavy.1.raw 17804
ctatgcgccttgccagccgctcagacagtatataggaagtagtccttgaccaggcagcccaggccgctgtgctctcgaggtgctcctggagcagggcgccaggggaagaccgatgggccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggcctcaacggaatcaccgtagacttgatttcctccatgaaatgacacacctgccacccactccagcccctcgcctggagcctggcggacccacctgcatattccaattatcgaaggtgaatccagaggcctgcacaggagagtctcagggaccccccctactggggccacgcctcccccagactccacgaattgcacctgacacatgacacctcttaagagggcaacgaggaaacccagctcagccccaaactccatggtgagtcctctgtgttccagtgatgatcaccgagtggaaacaccggcgacttccagtgctgggctcgtctcccaggccccaaaccttcgatcgcgtctaaatcgagcaccggtcgtgatagtatagactgatggcgccgaggaggcgatacg

SEQ ID NO: 790749 - DNA, 654 bp, Homo sapiens
  misc_feature: 17806.44.86.H09.1.pb.heavy.1.raw 17806
cgtatcgcctccctcgcgccatcagacagtatatacacgaccggtgctcgatttagtgctatagacttgggttttggggatgcctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggaggggaatggagtggattggtgacatccattatactgggggcgacgtactactctccgtccctcaagagtcgtctcaccatttcgaggacacgtccatgaaccgcttctcccctgaaactgacctccgtgaccgccgcgacacggccgtttatttctgtgcgaggcgagactggtctttcaatctatggggccgtggcaccctggtcactgtctcctcagcttccaccaagggcccatcggtcttcccctggcgccctgctccaggagcacctctgggggcacagcggccctgggctgcctggtcaaggactacttcctatatactgtctgagcgggctggcaggcgcatag

SEQ ID NO: 790750 - DNA, 676 bp, Homo sapiens
  misc_feature: 17825.44.35.D02.1.pb.heavy.1.raw 17825
cgtatcgcctccctcgcgccatcagacagtatatacacgaccggtgctcgatttagcacacgatagttgggtttgggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctgtggttacatcagtagtttttattggagttggctgcggcagtccgccgggaagggactggagtggattgggcgcatctatacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagttagagacggggggggcgaactggctcgacccctggggccagggaaccctggtcaccgtctcctcagcctccaccaagggcccatcggtcttccccctggcaccctcctccaagagcacctctgggggcacagcggccctgggctgcctggtcaaggactacttcctattactgtctgagcggctggcaaggcgcatag

SEQ ID NO: 790751 - DNA, 728 bp, Homo sapiens
  misc_feature: 17827.UNK.UNK.UNK.pb.heavy.1.raw 17827
ctatgcgccttgccagcccgctcagacagtatataggaagtagttccttgaccaggcagcccagggccgctgtgcccccagaggtgctcttggaggagggtgccagggggaagaccgatggggccctttggtggaggcggaggcgacggtggacccagggttccctggccccagaagtcaaaacgaataataaccactccgagcgccgacttgtctcgcacagtaataagacggccgtgtcgtcgcctctcaggttgttcatttgaagataaaaccgtgttcctggaattgtccctggagatggtgaatcggccttcacggagtctgcgtagtatgtgaaatcaccagtataaatgactgagacccactccagcccttccctggaggcctggcggacccaactcatgtagttgctgctgacggtgagcccagaggctgcccacaggagagtctctgggaccccccaggctggacttaagcctcctccagactccatcagccgcaccttcacactggaccaccttttaaaaagtccaaacaaggagaaacccagctcagccaaaaaactccatggtgagtcctctgtgtttcagtgctgatcaccgaaatggaaaacacctcggaatcccagtgctgggctcctctccccccccaaacccaacgtgcgagtgctaaatcgagccaccggtcgtgtatatactgtctgatggcgcgagggaggcgatacg

SEQ ID NO: 790752 - DNA, 688 bp, Homo sapiens
  misc_feature: 17849.44.73.G07.1.pb.heavy.1.raw 17849
cccgctcagacagtatataggaagtagtccttgatcaggcagcccaggccgctgtgctctcggaggtgctcctggagcagggcgccagggggaagagaccgatgggcttggtggaggctgaggagacggtgacagtgtcccctggccccagtgaaacgcccgataatagctgctgccacttcccgatctcgcaccagtaatacagagccgagtctcgcctctcaggctgatcatttccaggtacagaggtgtttccggaattgtctctggagatggtgaatcggccctcacggagtctgcataatatcgtagaagtccatcatatgcctataactgcaaccactccggccccttgcctggagcctggcggacccagtgcatgccagactactgaaaactaaatcacagaggcttcacaggagagtctcagggacctcccaggctggaccacgcctccccgcagcccaccaggtgcacctgacactggacacctcttaaaagagtaacgaggaaacccagctcagccaaactccatgggtgagtcctcctgtgttcagtgctgatcacacccgaatggaaacacgccggacttctagtgctgggctcctctcccagagctcccctgagcgtagagctaaatcgagcaccggtcgtgtatatctgtctgatggcgagggagggcgatacg

SEQ ID NO: 790753 - DNA, 676 bp, Homo sapiens
  misc_feature: 17854.UNK.UNK.UNK.pb.heavy.1.raw 17854
ctatgccttgccagcccgctcagaagtatataggagtagtccttgaccaggcagcccagggcgctgtgcccccagaggtgctctggagcagggcgccaggggaagaccgatgggcccttggtggaagctgaggtgacaatgaccagggttccctgcccccagatctcaaaggctccatgcgagctggggtacggactctcgcacagtagtagacggccgtgcgtcggatttcaaagaaactcattgtcatggagactgtgtctgtgacttgtccgcgtaatcgtaatctgccccgaagtctcgtgcgtaggtgagtgagccaaaaagagggatgattccacccatccactcaagcccttgtccagggcctggcgcacccagttgatggtataagtagtggaactggtagtacttccagaggcgtgcaggaaagggtcaccgagaccaaggttgcgcattctagtcccagactgcaccagttgcaccagggactggacacctgttgctgctgccaccacaaagagaacctccaggtccagtccatggtgatgagctgtgctcccagggcttctttagaggaggaatgtggttgttatgtgatgctcccctgatagagctactaaatcgagcaccgggtcgtgtatatactgtctgatggcgcgagggaggcgatacg

SEQ ID NO: 790754 - DNA, 705 bp, Homo sapiens
  misc_feature: 17869.UNK.UNK.UNK.pb.heavy.1.raw 17869
ctatgcgcccttgccagcccgctcagacagtatataggaaagtagtccttgaccaggcagcccagggccgctgtgctctcggaggtgctcctggagcagggcgccagggggaagaccgatgggcccttggtgaggctgaggagacggtgaccagggttcccctggcccccagtggacagttcctgatataaacacaacacaataatacgatgcccgtgtcctcggttttcaggttagtcattcgcagaatcaatgagttcttgaagtcatctcttgagaggggtgaatctggcttcacagacgcggcgtctctgtgataaagctggcaactttgtttttactgcggccaagccactccagccccttccctggagcctggcggacccagtccatatagtggtcactgatggtgaatccagaggcgacacagagagtctcagggaccctccaggctggacaagtctccccggactccacaactgcacttcactctggacaccttgtaaaataacaacaaggaaaacccagctcagcccgaactccatggtgagtcctctgtgttcagtgctgatcaccaaatgaaaacacctgggaattctgggggctgggctccgctctcagagctccccaagagagatcgtgacgcagctaaatcgacggcccggtcgtgtatatactgtctgatggcgccgaggaggcgatacg

SEQ ID NO: 790755 - DNA, 675 bp, Homo sapiens
  misc_feature: 17881.44.53.E09.1.pb.heavy.1.raw 17881
cgtatcgcctccctcgcgccatcagacagtatatacacgaccggtgctcgatttagagagagtgtgttgagctctggagaggagccccagccttgggattccaggtgttttcattcagtgatcaggactgaacacagaggactcaccatggagtttgggctgagctggattttccttgctgctattttaaaaggtgtccagtgtgaggtgcagttggtggagtctggggaggtttggtaaagcctggggagtcccttagactctcctgtgcagcctctggattcactttcagtaacgcctggatgacctgggtccgccaggctccagggaaggggctggagtggttggccgtattagaaccaagctgacggtgggacagcagactacgctggcaccgtgaaaggcagattcaccatctcaagagatgattcaaaagatacggtgtctctgcagatgaacagcctgaacaccgaggacacagccgtctattactgtctgggatggtttcattcggccagggaaccctggtcaccgtctcctcagcctcccacaagggcccatcgtcttcccctggcgccctgctccaggagcacctccgagagcacagcggccctgggctgcctggtcaaggactacttcctatatactgtctgagcgggctggcaaggcgcatag

SEQ ID NO: 790756 - DNA, 680 bp, Homo sapiens
  misc_feature: 17941.44.73.G07.1.pb.heavy.1.raw 17941
ctatgcgccttgccagcccgctcagacagtatataggaagtagtccttgaccaggcagcccagggccgctgtgctctcggaggtgctcctggagcagggcgccagggggaagaccgatgggcccttgtggaggctgaggagacggtgaccaggttccctggcccagtagtcaagcggggaccgtctcgaggggctctcgcacaataatagacagccgtgtcctcacttgtgaggttgtacatttgcagatgcagtgtgttcctggaattgtctctggagacggtgaatcggcccttctcggagtctccgtagtgttcttcaattccatcttctgatataattgccacccactccagccccttgcctggagcctggcggacccagtgcatggcataggtctgaagatgaatccagaggctgcacaggagagtctcaggagttccaggctgggccgctcctccccagactccactagctgcacctgacactggccacctcttaaagagcaacgaggaaaacccatctcagcccaaagtccatggtgagtcctctgtgttcagtgatgatcaccgaatggaaacaccgcgacttcagtgctgggctcgtctcccccctgagcgtagagctaaatcgagcaccggtcgtgtatatactgtctgatggcgcgaggaggcgatacg

SEQ ID NO: 790757 - DNA, 701 bp, Homo sapiens
  misc_feature: 17984.44.36.D03.1.pb.heavy.1.raw 17984
ctatgcgccttgccagcccgctcagacagtatataggaagtagtccttgaccaggcagcccagggccgctgtgctctcggaggtgctcctggagccagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaaacacctgggaattctggggctggggctccgctctcccccaagagagatcgtgacgcagctaaatcgagcaccggtcgtgtatatactgtctgatggcgcgagggaggcgatacg

SEQ ID NO: 790758 - DNA, 572 bp, Homo sapiens
  misc_feature: 18001.UNK.UNK.UNK.pb.heavy.1.raw 18001
cgtatcgcctccctcgcgccatcagacagtatatacacgacggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790759 - DNA, 680 bp, Homo sapiens
  misc_feature: 18049.44.35.D02.1.pb.heavy.1.raw 18049
cgtatcgcctcccatcgcgccatcagacagtatcataacacgaccggtgctcgatttagcacacgatagttgggtttgggatactttctgagactcatgggcctcctgcacaagaacatgaaacacctgtggttcttcctcctcctggtggcaccgtcccaggcatgggtcgtgtccgaggtgcagctgcaaggagtcggggcccaggacgggtgaagcttcggagaccctgtcccgtcacctgcaatgtctctggtggcttacatcagtagcttattattggagttggctgcggcagtccgccgggaagggactggagtggatgggcgcatctataacagtggcagcaccaataaaccccgcctcaagagtcgagtcaccatgtcgactagacaggtccagagaaccagttctccgctgaaattgattctgtgaccgccgcgacacggccgtatattattgtgcgagagattcctatcgatacagtagagacgggggggcgaactggctcgacccctggggccagggaaccctgtccaccgtctcccagcccccaccaagggcccatcggtctttcccctggcaccctcctccaaagagcactctgggcacagcggcctgggctggctggtcaaggaccactatccatatactgtctgagcggctggcaaggcgcatag

SEQ ID NO: 790760 - DNA, 693 bp, Homo sapiens
  misc_feature: 18066.44.55.E11.1.pb.heavy.1.raw 18066
ctatgcgccttgccagcccgctcagacagtatataggaagtagtccttgaccaggcagccagggccgctgtgcccccagaggtgctcttggaggagggtgccagggggaagaccgatgggcccttggtggaggcggaggcgacggtgaccagggttccctggcccagaagtcaaacgaataataaccactccgagcgccgacttgtctcgcacagtaatagacggccgtgtcgtcgcctctcaggttgttcatttgagataaaccgtgttcctgaattgtccctggagatggtgaatcggcccttcacggagtctgcgtagtatgtgaaatcaccagtataaatgactgagacccactccagccccttcctggagcctggcggacccaactcatgtagtgctgctgacggtgagcccagaggctgcacaggagagtctctggaccccccaggctggactaagcctcctccagactccatcagccgcacctcacactggacaccttttaaaagtccaacaaggagaaccagctcagccaaaactccatggtgagtcctctgtgttcagtgctgatcaccgaatggaaacacctcggaatcccagtgctgggctcctctccccaaaccaacgtgcgagtgctaaatcgagcaccggtcgtgtatatactgtctgatggcgcgaggaggcgatacg

SEQ ID NO: 790761 - DNA, 699 bp, Homo sapiens
  misc_feature: 18075.44.27.C05.1.pb.heavy.1.raw 18075
ctatgcgccttgccagcccgctcagacagtatataggaagtagtccttgaccaggcagcccagggccgctgtgctctcggaggtgctcctggagcagggcgccaggggaagaccgatgggcccttggtggaggccgaggagacggtgaccagggttccctggccccaggcgtcgaatgaaccgattttggaaacagatagtctcgcacaaaaatacacggccgtgtctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggaccccctactgggccacgcctccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagccccaaacccttcgatcgcgtctaaatcgagcaccggtcgtgtatatactgtctgatggcgcgagggaggcgatacg

SEQ ID NO: 790762 - DNA, 702 bp, Homo sapiens
  misc_feature: 18082.44.67.G01.1.pb.heavy.1.raw 18082
cgtatcgcctcctcgcgccatcagacagtatatacacgaccggtgctcgatttagagtatacatattgggtttgggggggagaggagcccagcactgggattcgaggtgttttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaaggccgattcaccatctccagggacaattccagaaacacggtttatcttcaaatgaacaacctgagaggcgacgacacggccgtctattactgtgcgagacaaagtcggcgctcggagtggttattattcgtttgacttctggggccagggaaccctggtcaccgtcgcctccgcctcaccaagggcccatcggtcttccccctggcacctcctccaagagcacctctgggggcacagcggccctgggctgcctggtcaaggactacttcctatatactgtctgagcgggctggcaaggcgcatag

SEQ ID NO: 790763 - DNA, 722 bp, Homo sapiens
  misc_feature: 18083.44.27.C05.1.pb.heavy.1.raw 18083
cgtatcgcctccctcgcgccatcagacagtatatacacgaccggtgctcgattttagacgcgatcgaagggttttgggggctgggagacgagccccagcactggaagtcgccggtgtttccactcggtgatcatcactgaacacagaggagctcaccatggagttttgggctgagctgggttttcctcgttgccctcttaagaggtgtcatgtgtcaggtgcaattcgtggagtctgggggaggcgtggccccagtagggggtccctgagactctcctgttgcagcctctggattcacctttcgataattggaatatgcagtgggtccgccaggctccaggcgaggggctggagtgggtggcaggtgtgtcatttcatggaggaaatcaagtctacggtgattccgttgagggggccgattcaccatctctccagagacaattccgagaacacagtgtctcttcaaatgaacaggcctgagacctcaggacacggccggtgtatttttgtgcgagactatctgttccaaaatcggtttcattcgacgcctcggggccagggaaccctggtcaccgtctcctcggcctccaccaagggcccatcggtcttccccctggccgcccctgctccaggagcacctccgagagcacaggcggccctgggctgcctggtcaagcgactacttcctatatactgtctgagcgggctggcaaggcgcatag

SEQ ID NO: 790764 - DNA, 603 bp, Homo sapiens
  misc_feature: 18086.UNK.UNK.UNK.pb.heavy.1.raw 18086
ggaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaagtaaactcaacaccccaagcaggctatgtggggggtgataggggtggattctatttcctatcccatcccctaggatctcaattaagttactagcgagttaaatgtctgtagcgatcccgtcagtcctatcgcgcgcatcaagacctggttggtgagcgtgcagtagatcatcgataagctgcgagttaggtcatccagacgcatctggcgcctaaacgttcagtggtagctaaggcgtcaccttcgactgtctaaaaggcaatatgtcgtccttagctccaagtccctagcaagcgtgtcgg

SEQ ID NO: 790765 - DNA, 705 bp, Homo sapiens
  misc_feature: 18095.44.36.D03.1.pb.heavy.1.raw 18095
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacaccagaggactcaccatggagttcgggctgagctgggttttccttgttgttattttacaaggtgtccagagtgaagtgcagttggtggagtccgggggagacttggtccagcctggaggtccctgagactctcctgtgtcgcctctggattcaccatcagtgaccactatatggactggggtccgccaggctccagggaaggggctggagtggcttggccgcagtaaaaacaaagttgccagctttatcacagagtacgcccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccacaggccccatcggtcttccccctggcgccctgctccaggagcacctccgagagcacagcggccctgggctgcctggtcaaggactacttcctatatactgtctgagcgggctggcaaggcgcatag

SEQ ID NO: 790766 - DNA, 722 bp, Homo sapiens
  misc_feature: 18096.44.85.H08.1.pb.heavy.1.raw 18096
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctcccccagactccaccagctgcacctgacactggacacctcttaaaagagcaacgaggaaaaccagctcagcccaaactccatggtgagtcctctgtgttcagtgctgatcaccgaatggaaacaccgccgacttctagtgctgggctcctctcccagagctccccgcgactgagtgatactaaatcgagcaccggtcgtgtatatactgtctgatggcgcgagggaggcgatacg

SEQ ID NO: 790767 - DNA, 708 bp, Homo sapiens
  misc_feature: 18099.44.27.C05.1.pb.heavy.1.raw 18099
cgtatcgccctccctcgcgccatcagacagtatatacacgaccggtgctcgatttagacgcgatcgaagggtttggggagccctggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtcctgagactctcctgtgcagcctctggattcaccttcgataattggaatatgcagtgggtccgccaggctccaggcgagggcctggagtggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttcccccctggcgccctgctccaggagcacctccgagagcacagcggccctgggctgcctgggtcaaggactacttcctatatactgtctgagcgggctggcaaggcgcatag

SEQ ID NO: 790768 - DNA, 692 bp, Homo sapiens
  misc_feature: 18113.44.35.D02.1.pb.heavy.1.raw 18113
cgtatcgcctccctcgcgccatcagacagtatatacacgaccggtgctcgatttagcacacgatagttgggtttgggggatacttttctgagactcatggccctcctgcacaagaacatgaaaccactgtggttcttcctcctcctggtggcacctcccagatgggtcgtgtccgaggtgcagctgcaggagtcgggccaggacgggtgaagcctctcggagacccctgtcccctcacctgcaatgtctctggtggttacatcagtagttattattggagttggctgcggcagtccgccgggaagggactggagtggattgggcgcatctataacagtgcagcaccaactacaaccccgccctcaagagtcgagtcaccatgtcactagacaggtccaaagaaccagttctccctgaaattgacttctgtgaccgcgcggacacggccgtatattattgtgcgagagattcctatcgatacagtagagacggggggggcgaactgggctcgaccccctggggccagggaaccctggtcaccgtctcctcagcctccaccaaagggcccatccggtcttccccctggcaccctcctccaagagcacctctgggggcacagcagcgcccctgggctgctgggtccaaggactacttcctatatactgtctgagccgggcctggcaagcgcatag

SEQ ID NO: 790769 - DNA, 732 bp, Homo sapiens
  misc_feature: 18121.44.33.C11.1.pb.heavy.1.raw 18121
ctatgcgccttgccagcccgctcagacagtatataggaagtagtccttgaccaggcagcccagggccgctgtgcccccagaggtgctcttggaggagggtgccaggggaagaccgatgggcccttggtggaggctgaggagacggcgaccgtggtcccttggccccagggcgtccataccattggagtagagcatgtcatatctgtatcccacgagccccatctctcgcacagtagtagacagccgtgtcctcggctctcaggctattcatttccaagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgcctacacaggagagtctcagggacctcccaggctggaccacgcctccccagactccaccagcttcacctgacactggacacctctttaaaagagcaacgaggaaaaacccaggtcagcccaaactcccatggtgagtcctctgtgttcgggctgatcaccgactggaaacaccgccgacttctggtgctgggctcctctcccagagctcccaaaccaacgagctcactctaaatcgagcaccggtcgtgtatatactgtctgatggcgcgagggaggcgatacg

SEQ ID NO: 790770 - DNA, 704 bp, Homo sapiens
  misc_feature: 18131.44.35.D02.1.pb.heavy.1.raw 18131
cgtatcgccctcctcgcgccatcagacagtatatacacgaccggtgctcgatttagcacacgatagttggtttggggatactttctgagactcatggcctcctgcacaagaacatgaaacacctgtgttcttcctcctcctggtggcacctccccagatgggtcgtgtccgaggtgcagctgcaggagtcggccaggacgggtgaagccttcggagaccctgtccctcacctgcaatgtctctggtggttacatcagtagttattattggagttggctgcggcagtccgccgggaagggactggagtggattgggcgcatctataacagtggcagcaccaactacaaccccgccctcaagagtcgagtcaccatgtcactagacaggtcaagaaccagttctccctgaaattgacttctgtgacgccgcggacacggccgtatattattgtgcgagagattcctatcgatacagtagagacgggggggcgaactggcttcgaccctggggccagggaacccctggtcaccgtctcctcagcctccaccaagggcccatcggtcttccccctggcaccactccccctctccaagagcaggacgctctgggggtcggtgcacggcggccctgctgggcgggccctgggctgcctggtcaaggactacttcctatatactgtctgagcgggctggcaaggcgcatag

SEQ ID NO: 790771 - DNA, 677 bp, Homo sapiens
  misc_feature: 18137.UNK.UNK.UNK.pb.heavy.1.raw 18137
cgtatcgtcctccctcgcgccatcagacagtatatacacgaccggtgctcgatttagtgcctatagactaatgggttttggggatgctttctgagagtcaaggagcctcctgtgcaagaacatgagagcacctgtggtttttcctcctgctggtggcagctcccagatgggtcctgttcccaggtgcagctgcaggagtcgggcccaggactggtgaggccttcgggaacccctgtctctcatctgcactgtctctggagtttccatcagttctgatcattcttggggctggatccggcagcccccagggaggggaatggagtggatttggtgacatccatttatactggggcgacgtactactctccgtccctcaagagtcgtctcaccattttcgagggacacgtccatgaaccggcttctccctgaaactgacctccgtgaccggccgcggacacggccgttttatttctgtgcgaggcgagactggtctttccaatctatggggccgtggccaccctggtcactgtctcctcagcttccaccaagggcccatcggtcttccccctggcgccctgctccaggagcacctctgaggcggcacagcggccctggggcctgcctgggtcaaggactacttcctatatactgtctgagcgggctggcaaggcgcatag

SEQ ID NO: 790772 - DNA, 607 bp, Homo sapiens
  misc_feature: 18154.44.36.D03.1.pb.heavy.1.raw 18154
cgtatcgcctccctcgcgccatcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatgcgggaaagaaacagctggtttctgtattataagtcttaccatctggacgtctggggcaaagggaccacggtcaccgtctcctcagcttccaccaagggcccatcggtcttccccctggcgccctgctccaggagcacctctgggggcacagcggcctgggctgcctggtcaaggactacttcttatatactgtctgagcgggctggcaaggcgcatag

SEQ ID NO: 790773 - DNA, 692 bp, Homo sapiens
  misc_feature: 18181.44.36.D03.1.pb.heavy.1.raw 18181
cgtatcgcctcctcgcgccatcagacagtatatacacgaccggtgctcgatttagctgcgtcacgatctctcttggggagagcggagccccagccccagaattcccaggtgttttcatttgtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaccgaggacacgggcatgtattattgtgttgtgtttatatcaggaactgtcactggggccagggaaccctggtcaccgtctcctcagcctccaccaagggcccatcggtcttccccctggcgcctgctccaggagcacctccgagagcacagcggccctgggctgcctggtcaaggactacttcctatatactgtctgagcgggctggcaaggcgcatag

SEQ ID NO: 790774 - DNA, 648 bp, Homo sapiens
  misc_feature: 18195.UNK.UNK.UNK.pb.heavy.1.raw 18195
cgtatcgcctccctcgcgcatcagacagtatatacacgaccggtgctcgatttagtacaccgtgattagggattggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccagggaggggaatgagtggattggtgacatccattatactgggcgacgtactactctccgtccctcaagagtcgtctcaccatttcgagggacacgtccatgaaccgcttctcctgaaactgacctccgtgaccgccgcggacacggccgtttatttctgtgcgaggcgagactggtctttcaatctatgggcgccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 790775 - DNA, 726 bp, Homo sapiens
  misc_feature: 18212.44.33.C11.1.pb.heavy.1.raw 18212
cgtatcgcctccctcgcgccatcagacagtatatacacgaccggtgctcgatttagagtgagctcgttgggtttgggagctctggagaggagcccagcaccagaagtcgcggtgtttccagtcggtgatcagcaccgaacacagaggactcaccatggagtttgggctgacctgggtttttcctcgttgctcttttaagaggtgtccagtgtcaggtgaagctggtggagtctggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtgggatacagatatgacatgctctactccaatggtatggacgcctggggccaagggaccacggtcgccgtctcctcagcctccaccaaggcccatcggtcttcccctggcaccctcctccaagagcacctctgggggcacagcggccctgggctgcctggtcaaggactacttcctatatactgtctgagcgggctggcaaggcgcatag

SEQ ID NO: 790776 - DNA, 723 bp, Homo sapiens
  misc_feature: 18230.44.27.C05.1.pb.heavy.1.raw 18230
ctatgcgccttgccagcccgctcagacaggtatataggaagtagtccttgaccgggcagcccagggccgctgtgctctcggaggtgctcctggagcagggcgccaggggaaagaccgatgggcccttggtggaggccgagggagacgtgaccagggtttccctggccccaggcgtcgaatgaacccgattttggaaacagatagtctcgcacaaaaatacacacggccgcggtcctgaggtctcaggctgttttcatttgaagaagacactgtgttctcggaattgtctctggagatgggtgaatcggccctcaacggaatcaccgtagaacttgattcctccatggaaaatgaacacacctgccacccactccagcccctcgcctggagcctggcggaacccactgcatattccaattatcgaaggtaatccagaggctgcacagagagttctcagggacccccctactggggccacgctcccccagactccacgaaattgcacctgacacatgacacctcttaagagggcaacgaggaaaaacccagctcagcccaaactccatggtgcagtcctctgtgtttcagtgatgatcaccgagtggaaaacaccggcgacttccagtgctgggctcgtctcccaggcccaaacccttcgatcgcgtctaaatcgagcaccggtcgtgtaatattactgtctgatggcgcgagggaggcgatacg

SEQ ID NO: 790777 - DNA, 656 bp, Homo sapiens
  misc_feature: 18280.UNK.UNK.UNK.pb.heavy.1.raw 18280
ctatgcgcctgccagccccctcgacagtatataggaagtagtccttgaccaggcagcccagggccgctgtgccccagagtgctcttggaggagggtgccaggggaagaccgatgggcccttggtggaggctgaggagacgggtgaccagggttccctggccccagtggtcaaagtagtttggtgaccgaactgccctactctcgcacagtaatacaccggcgtgtccgcggggctcacagagctcagcttcagggagaactggttcttggacgtgtctactgatatggtgactcgactcttgagggacggtgtagtaggctgcccccactatatagatactcccaatccatccagcccccttccctgggggctgggcgatccagccccatagtactactactgctgatggagccacgagaccagggcaggtgagggacagggtctccgaaggcttcaccagtcctgggcccgactcctgcagctggcagctgggacaggaccatctgggaagccgcaccagcaggaggaagaaccacaggtgcttcatgttcttgcacaggaggtccatgactctcagaaagccccgcggaatctacactactaaatcgagcacggtcgtgtatatactgtctgatggcgcgagggaggcgatacg

SEQ ID NO: 790778 - DNA, 701 bp, Homo sapiens
  misc_feature: 18330.UNK.UNK.UNK.pb.heavy.1.raw 18330
ctatgcgccttgccagcccgctcagcagtatataggaagtagtccttgaccagccagccagggccgctgtgctctcggaggtgctcctggagcagggcgccagggggaagaccgatgggcccttggtggaggctgaggagacggtgaccagggttccctggcccagtggacagttcctgatataaaaccaacacaataatacatgcccgtgtcctcggttttcaggtagtcattcgcagaatcaatgagttcttgaagtcatctcttgagagggtgaatctggcttttcacagacgcggcgtactctgtgataaagctggcaactttgttttactgcggccaagccactccagcccttccctggagcctggcggacccagtccatatagtggctcactgatggtgaatccagaggcgacacaggagagtctcagggaccctccaggctggaccaagtctccccccggactccaccaactgcacttcactctggacaccttgtaaaataacaacaagaaaacccagctcagcccgaactccatggtgagtcctctgtgttcagtgctgatcaccaaatgaaacacctgggaattctggggctggggctccgctctcagagcccccaagagagatcgtgacgcagctaaatcgagcaccgggtcgtgtatatactgtctgatggcgcgaggggaggcgatacg

SEQ ID NO: 790779 - DNA, 713 bp, Homo sapiens
  misc_feature: 18344.UNK.UNK.UNK.pb.heavy.1.raw 18344
cgtatcgcctccctcggcgccatcagacagtatatacacgaccggtggctcgatttagctgcgtcacgatctctcttgggggagagcggagcccagccagaattcccaggtgttttcatttgtgatcaggccactgaacacagaggactcaccatggagttcgggctgagctgggttttccttgttgttattttacaaggtgtcccagagtgaaagtgcagttggtggagtccgggggagacttggtcccagcctgggagggtccctgagactctcctccgtgtcgcctctgattcaccatcagtgaccactatatggactccgggtccgccaggctccagggaagggggctggagtgggcttggccgcagtaaaaacaaagttgccagctttatcacagaagtaccgccgcggtctgtgaaagccagattcaccctctcaaagagatgactctcaagaactcattgattctgcgaatgactaacctgaaaaccgaggacacgggcatggtattattgtgttgtgtttataatcaggccactgtcacctgggggccagggaaccctggtcaccgtctcctcagcctccaccaaggccatcggtcttccctgcgccctgctccaggagcactccgagagcacagcgccctgggctggcctggtcaaggactacttcctattatactgtctggagcgggctggcaaggcgcatag

SEQ ID NO: 790780 - DNA, 657 bp, Homo sapiens
  misc_feature: 18355.44.86.H09.1.pb.heavy.1.raw 18355
ctatgcgccttgccagcccgctcagacagtatataggaagtagtccttgaccaggcaggcccagggccgctgtgcccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattccccctccctgggggctgccggatccagccccaagaatgatcagaactgatggaaactccagagacagtgcagatgagagacagggttcccgaaggcctcaccagtcctgggcccgactcctgcagctgccacctgggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 790781 - DNA, 654 bp, Homo sapiens
  misc_feature: 18366.UNK.UNK.UNK.pb.heavy.1.raw 18366
cgtatcgcctccctcgcgccatcagacagtatatacacgaccggtgctcgattttagtgctaatagacttggtttggggatgctttctgagagtcaaggacctcctgtgcaagaacatgaagcacctgtggtttttcctcctgctggtggcagctcccagatgggtcctgtcccaggtgcagctgcaggagtcgggccaggactggtgaggccttcggaaccctgtctctcatctgcactgtctctggagtttccatcagttctgatcattcttggggctggatccggcagccccagggaggggaatggagtggattggtgacattccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtctttcccctggcgccctgctccaggagcacctctgggggcacagcggccctgggctgcctggtcaaggactacttcctatatactgtctgagcgggctggcaaggcgcatag

SEQ ID NO: 790782 - DNA, 605 bp, Homo sapiens
  misc_feature: 18390.UNK.UNK.UNK.pb.heavy.1.raw 18390
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgccacagcaagcggccaatctttacgccacgttgaattgtttattacctgtgactggctatggcttgcaacgccactcgtaaaactagtactttgcggttagggaagtagacaaacccattactccacttcccggaagttcaactcattccaacacgaaataaaagtaaactcaacaccccaagcaggctatgtggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaaacgttcagtggtagctaaggcgtcaccttcgactgtctaaaggcaatatgtcgtccttagctccaagtccctagcaagcgtgtcgg

SEQ ID NO: 790783 - DNA, 689 bp, Homo sapiens
  misc_feature: 18411.44.21.B10.1.pb.heavy.1.raw 18411
ctatgcgcctgccagcccgctcagacagtattaaggaagtagtccttgaccaggcagcccaggggccgctgtgctctcggaggtgctcctggagcaggcgccaggggaagaccgatgggcccttggtggaggctgaggagacggtgaccagggttccctggcccccaagtggacagttccctgatataaacacaacacaataatacatgcccgtgtcctcggttttcaggttagtcattcgcagaatcaatgagttcttgaagtcatctcttgagagggtgaatctgctttcacagacgcggcgtactctgtgataaagctggccaactttgtttttactgcggccaagccactccagccccttccctggagcctggcggaccagtccatatagtggtcactgatggtgaaatccagaggcgacacaggagagtctcagggaccctccaggctggaccaagtctccccggactccaccaactgcacttcactctggacaccttgtaaaataacaacaaggaaaacccagctcagccccgaactccatggtgagtcctctgtgttcagtgctgatcaccaaatgaaaacacctgggaattctggggctggggctccgctctctcttgcgacgacactaaatcgagcaccggtcgtgtatatactgtctgatggcgcgaggaggcgatacg

SEQ ID NO: 790784 - DNA, 679 bp, Homo sapiens
  misc_feature: 18431.UNK.UNK.UNK.pb.heavy.1.raw 18431
ctatgcgccttgccagcccgctcagacagtatataggaagtagtccttgaccaggcagcccagggccgctgtgctctcggaggtgctcctggagcagggcgccagggggaagagcctggccttggtggaggctgaggagaccggggaccgcggctcctgggccccagtagaacgatgggctcgtacaataatagagagccgagtcctcggctctcaattgttcatttgtagatacacggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcagggacgtcccaggctggaccaccgcctccccagactccaccagctgaacctgacactggacacctcttaaaagagcaacgaggaaaacccagcttcagccaaactccatggtgagtcctctgtgttttcagtgctgatcaccgaatggaaacccgccgacttctagtgctgggcttcctctcccagcccctttccctcgactcactaatcgagcaccggtcgtgtatatactgtctgattggcggagggagggcgatacg

SEQ ID NO: 790785 - DNA, 725 bp, Homo sapiens
  misc_feature: 18446.44.85.H08.1.pb.heavy.1.raw 18446
ctatgcgccttgccagcccgctcagacagtatataggaagtagtccttgaccaggcagcccagggccgctgtgccccccagaggtgctcttggaggagggtgccaggggaagaccgatgggcccttggggaggctgaggagacggtgaccgtggtcccttggccccagacgtccataccgtagtagtagtcccagcaggttggtagtactacaatatgtcctcgcacagtaatacacagccgtcgtcctcgctctcaggctgttcatttgcagatacagcgtgtttttggaattgtctcctggagatggtgaatcggccccttcacggagtctgcatagtatttattacttccatcataccatataagtgccacccactccagccccttgcctggagcctggcggacccagtgcatgccataggtactgaaggtgaatccagacgctgcacaggagagtctcagggacctccccaggctggaccacgcctccccagactccaccagctgcacctgacactggacacctcttaaaagagcaaacgaggaaaacccaccagctcagcccaaactccaatggtgagtcctctgtgttcagtgctgatcaccgaatggaaacaccgccgacttctagtgctgggctcctctcccccccgcgactgagtgatactaaatcgagcaccggtcgtgtatatactgtctgaaatggcgcgaggaggcgatacg

SEQ ID NO: 790786 - DNA, 707 bp, Homo sapiens
  misc_feature: 18453.44.27.C05.1.pb.heavy.1.raw 18453
cgtatcgcctccctcgcgccatcagacagtataatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctggggaggcgtggcccagtaggggggtccctgagactctcctgtgcagcctctggattcaccttcgataattggaatatgcagtgggtccgccaggctccaggcgaggggctggagtgggtgcaggtgtgtcatttcatggaggaaatcaagtctacggtgattccgttgagggccgattcaccatctccagagacaaattccgagaacacagtgtctcttcaaatgaacagcctgagacctcaggacacggccgtggtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaggactacttcctatatactgtctgagcgggctggcaaggcgcatag

SEQ ID NO: 790787 - DNA, 644 bp, Homo sapiens
  misc_feature: 18458.UNK.UNK.UNK.pb.heavy.1.raw 18458
ctatgcggccttgccagcccgcctcagatagtatataggagtagtagtccttgaccaggcgccaggggccaggcccgctgtgcccccagaggtgctcctggagcagggcgccaggggaaagaccgatgggccctgggtggaagctgagaggaacagtgaccagggtgcccacggccccattagattgaaagaccagtctcgcctcggcacagaaataaacggccgcgtgtccgcgcggtcacggaggtcagtttcaggggagaacggttcatggacgtgtccctcgaaatggtgagacgactcttggagggacggagagtagtacgtcgccccagtatatatggatgtcaccaatcactccattcccctccccctgggggctgccggatccagcccaagaatgatcagaactgatggaaaactccagagacagtgcagatgagagacagggttcccgaaaggcctcaccagtcctgggcccgactcctgcagcctgcacctgggacaggacccatctgggagctgccaccagcaggaggaaaaaccacaggtgttcaccctgcccccatccctaatccacgtgtactaaatcgagccaccggtcgtgtatatactggtctgatggcgcgagggagggcgatacg

SEQ ID NO: 790788 - DNA, 688 bp, Homo sapiens
  misc_feature: 18517.44.55.E11.1.pb.heavy.1.raw 18517
cgtatcgcctcctcgcgccatcgacagttatatacacgaccggtgctcgatttagcactcgcacgttggtttggggagaggagcccagcactggattccgaggtgtttccttcggtgatcagcactgaacacagaggactcaccatggagttttgctgagctgggttctccttgttggacttttaaaaggtgtccagtgtgaaggtgcggctgatggagtctggaggaggcttagtccagcctggggggtcccagagactctcctgtgcagcctctgggctcacgtcagcagcaactacatgagttgggtccgccaggctccagggaaggggctggagtggggtctcagtcatttatactggtgatttcacatactacgcagactccgtgaagggccgattcacatctccagggacaattccaggaacacggttatcttcaaatgaacaacctgagaggcgacgacacggccgtctattactgtgcgagacaagtcggcgctcggagtggttattattcgtttgacttctgggccaggaaccctggtcccgtcgcctccgcctccacaagggccatcggtcttccctggcacctcctccaagagcacctctggggcacagcggcctgggctgcctggtcaagggactacttcctatatactgtctgagccggctggcaaggcgcatag

SEQ ID NO: 790789 - DNA, 662 bp, Homo sapiens
  misc_feature: 18537.UNK.UNK.UNK.pb.heavy.1.raw 18537
cgtatcgcctccctcgcgccatcagacagtatacacgacggtgctcgatttagtagtgtagattccgcgggggctttctgagagtcatggacctcctgtgccaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactgggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttcccctggcaccctcctccaagagcacctctgggggcacagcggccctgggctgcctggtcaaggactacttcctatatactgtctgagcggggctggcaaggcgcatag

SEQ ID NO: 790790 - DNA, 757 bp, Homo sapiens
  misc_feature: 18578.UNK.UNK.UNK.pb.heavy.1.raw 18578
ctatgcgccttgccagcccgctcagacagtatataggaaagtagtcccttgaccaggcatgcccagggccgctgtgcccccagaggtgctcttggaggaggggtgccaggggggaagaccgatgggccctttggtggaggctgaggagacgggtgacccgtgggtccccttggccccagacgtccataccgtagtagtagtccccaagcagggtggtagtactacaatatgtcctcggcacagtaatacacagcccgtgtcctcggctctctcaggctgttcaatttgcagatacagcgtgttcttggaattgtctctggagatggtgaatcgcccttcacggagtctgcatagtattttattacttccatcatacccatataagtgccacccactcccaggcccctgtgccttggagcctggcggacccagtggcatgccataggtactgaaggtgaatccagacgctgcacaggaagagtcctcagggaccttcccaggctggaccacgcctcccccagactccaccagctgcaacctgacactggacacctctttaaaagagcaacgaggaaaaacccagctccagccccaaactccatggtgagtccttctgtgttcagtgctgatcaccgaatggaaacaccgccgacttctagtgctgggcctcctctcccagagctcccgcgactgagtgatactaaatcgagcacccggttcggtatatactgtctgatggcgcgagggaggcgatacg

SEQ ID NO: 790791 - DNA, 699 bp, Homo sapiens
  misc_feature: 18629.44.36.D03.1.pb.heavy.1.raw 18629
cgtatcgcctccctcgcgccatcagacagtatatacacgaccggtgctcgatttagctgcgtcacgatctctcttgggggagagcggagccccagcccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccagggaaggggctggagtgggcttggccgcagtaaaaacaaagttgccagctttatcacagagtacgccgcgtctgtgaaagccagattcaccctctcaagagatgacttcaagaactcattgattctgcgaaatgactaacctgaaaacgaggacacgggcatgtattattgtgttgtgtttatatcaggaactgtccactggggccagggaaccctggtcaccgtctcctcagcctccaccaagggccatcggtcttccccctggcgccctgctccaggagcacctccgagagcacagcggccctgggctgcctggtcaaggactacttcctatatactgtctgagcgggctggcaaggcgcatag

SEQ ID NO: 790792 - DNA, 699 bp, Homo sapiens
  misc_feature: 18641.44.36.D03.1.pb.heavy.1.raw 18641
cgtatcgcctccctcgcgccatcagacagtatatacacgaccggtgctcgatttagctgcgtcacgatctctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccaggcctggagggtccctgagactctcctgtggtcgcctctgattcaccatcagtgaccactatatggactgggtccgccaggctccagggaagggctggagtggctttggccgcagtaaaaacaaagttgccagcttatcacagagtacgccgcgtctgtgaaagccagattcaccctctcaagagatgacttccaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccctggcgccctgctccaggagcacctccgagagcacagcggcctggctgcctggtcaaggactacttcctatatactgtctgagcgggctggcaaggcgcatag

SEQ ID NO: 790793 - DNA, 695 bp, Homo sapiens
  misc_feature: 18650.UNK.UNK.UNK.pb.heavy.1.raw 18650
ctatgcgccttgcagcccgctcagacagtatataggaagtagtccttgaccaggcagcccaggccgctgtgcccccagaggtgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggccttcacggagtctgcgtagtatgtgaaatcaccagtataaatgactgagacccactccagccccttccctggagcctggcggacccaactcatgtagttgctgctgacggtgagcccagaggctgcacaggagagtctctgggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctggctcctctccccaaacccaacgtgcgagtgctaatcgagcacggtcgtgtatatactgtctgatggcgcgagggaggcgatacg

SEQ ID NO: 790794 - DNA, 660 bp, Homo sapiens
  misc_feature: 18651.44.12.B01.1.pb.heavy.1.raw 18651
ctatgcgccttgccagcccgctcagacagtatataggaagtagtccttgaccaggcagcccaggccgctgtgccccagaggtgctcttggaggagggtgccaggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctcccactataatagatactcccaatccaccccagcccttccctgggggctggcggatccagccccagtagtaactactactgctgatggagccaccagagacagtgcaggtgagggacagggtctccgaaggcttcaccagtcctgggcccgactcctgcagctgcagctgggacaggacccatctgggagccgccaccagcaggaggaagaaccacaggtgcttcatgttcttgcacaggaggtccatgactctcagaaagcccccgcggaatctacactactaaatcgagcaccggtcgtgtatatactgtctgatggcgcgaggaggcgatacg

SEQ ID NO: 790795 - DNA, 693 bp, Homo sapiens
  misc_feature: 18707.44.74.G08.1.pb.heavy.1.raw 18707
ctatgcgccttgccagcccccgctcagacagtatataggaagtagtccttgacccaggcagcccagggccgctgtgcccagaggtgctcctggagcagggcgccagggggaagacgatgggccctggtggaagctgaggtgacaatgaccagggttcctgcccccagatctcaaaggctccatgcgagctggggtacggactctcgcacagtagtagacggccgtgtcgtcggatttcaaagaactcattgtcatggagactggtggtctgtggacttgtccgcggtaatcgtaattctgccccggaagtctcgtgcgtaggtgagtgagccaaaaagagggaatgattccacccatccactcaagcccttgtccaggggcctggcgcacccagttgatggtataagtagtggaactggtagtacttccagaggccgtgcaggaaaagggtcaccgaggaccaaggttgcgcattctagtcccagactgcaccagttgcaccagggacggacacctgttgctgctgccaccacaaagaggaaacctccaggtccagtcatgggtgatagcgtgctcccaggggcttctttagaggaggaatgtggttgttatgtgatgctccccctgatagagctactaaatcgagcaccggtcgtgtatatactgtctgatggcgcgagggaggcgattacg

SEQ ID NO: 790796 - DNA, 573 bp, Homo sapiens
  misc_feature: 18722.44.78.H01.1.pb.heavy.1.raw 18722
cgtatcgcctccctcgcgccatcagacagtatatacacgaccggtgctcgatttagtgtgagtagtttggtttggggggaagaggaagactgacggtcccactccaggtacagctggtgcagtctggggctgagtgaagaagcctggggcctcagtgacagtctcctgcacggcttctggatacacgttcatcaattatgatattaactgggttgcgacagccgctggacaaggctgagtggatgggatggatgaagccctatagtggcaacacggctttgcccagaagttccaaggcagagttagtatgaccaggaacctccccaggtacagtctacatggaactgagcagcctgagatctgaggacacggccgtgtatttctgtgcgagagcaccagcacctggcttgacttgtgggggccagggaaccctggtcaccgtctcctcagcctccaccaaggcccatcggtcttccccctggcgcctgctccagagcacctccgagagcacagcgccctgggctgcctggtcaaggactacttcctatatacctgtctgagcgggctggcaag

SEQ ID NO: 790797 - DNA, 712 bp, Homo sapiens
  misc_feature: 18727.44.27.C05.1.pb.heavy.1.raw 18727
cgtatcgcctccctccgcgccatcagacagtatatacacgaccggtgctcgattagacgcgatcgaaggtttggggctgggagacgagcccagcactggaagtcgccggtgtttccactcggtgatcatcactggaacacagaggactcaccatggagttgggctgagctgggttttcctcgttgccctcttaagaggtgtcatgtgtcaggtgcaattcgtggagtctgggggaggcgtggccccccagtagggggtccctgagactctcctgtgcagcctctggcattcaccttcgataattggaatatgcagtgggtccgccaggctccaggcgagggggctggagtgggtggcaggtgtgtcatttcatgggaggaaatcaaggtctacggtgattccgttgagggccgattcaccatctccagagacaattccgagaacacagtgtctcttcaaatgaacagccctgagacctcaggacacggccgtgtatttttgtgcgagactatctgtttccaaaatcggttcatttcgacgcctggggccagggaaccctggtcacccgtctcctcggcctccaccaagggcccatcggtcttccccctggcgccctgctccaggagcacctccgagagcacagcggccctgggctgcctggtcaaggactactttcctatatactgtctgagcgggctggcaaggcgcatag

SEQ ID NO: 790798 - DNA, 690 bp, Homo sapiens
  misc_feature: 18752.44.36.D03.1.pb.heavy.1.raw 18752
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctggtttccttgtgttattttacaaaggtgtccagagtgaagtgcagttggtggagtccggggagacttgtccagcctggaggtcctgagactctcctgtgtcgcctctggattcaccatcagtgaccactatatggactggtccgccaggctccaggaagggctggagtggcttggccgcagtaaaaacaaagttgccagctttatcacagagtacgccgcgtctgtgaagccagattcaccctctcagagatgacttcaagactcattgatctgcgaatgactaacctgaaaccgaggacacgggcatgtattattgtgttgtgtttatatcaggaactgtccactgggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790799 - DNA, 605 bp, Homo sapiens
  misc_feature: 18753.UNK.UNK.UNK.pb.heavy.1.raw 18753
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatggcgcgcgataggactgacgggatcgctacagacatttaactcgctagtaacttaattgagatcctaggggatgggataggaaatagaatccaccctatcaccccccacatagcctgcttggggtgttgagtttacttttatttcgtgttggaatgagttgaacttccgggaagtggagtaatgggtttgtctacttccctaaccgcaaagtactagttttacgagtggcgttgcaagccatagccagtcacaggtaataaacaattcaacgtggcgtaaagatggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 790800 - DNA, 702 bp, Homo sapiens
  misc_feature: 18766.44.55.E11.1.pb.heavy.1.raw 18766
ctatgcgccttgccagcccgctcagacagttataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaaatcgagcaccggtcgtgtatatactgtctgatggcgcgagggaggcgatacg

SEQ ID NO: 790801 - DNA, 721 bp, Homo sapiens
  misc_feature: 18771.44.33.C11.1.pb.heavy.1.raw 18771
cgtatcgcctccctcgcgccatcagacagtatataccacgaccggtgctcgatttagagtgagctcgttggttttgggagctctgagagagcccagcaccagagtcggcgtgtgtttccagtcgtgatcagcaccgaacacagaggactcaccatggagtttgggctgacctgggttttcctcgttgctcttttaagaggtgtccagtgtcaggtgagctggtggagtctgggaggcgtggtccagcctgggaggtccctgagactctcctgtgtagcgtctggattcaccttccaacagacagcatgcactgggtccggccaggctccagcaagggactggagtgggtggcacttataatggtatgatggaaagtaataaatattatgtagattcctgaagggccgattcaccatctccagagaccaattcgaagaacacactatatctggaatgaatagcctgagagccgaggacacggctgtctactactggtgcgagagatggggctcgtggatacagatatgacatgctctactccaatggtatggacgccctggggccaagggaccacggtcgccgctcctcaggctccaccaaggggccatcgtcttcccctgcaaccctcctccaaggcacctctggggcacagcggcccctgggctgcctggtcaagactacttcctatatactgtctgagcgggcctggcaaggcgcatag

SEQ ID NO: 790802 - DNA, 643 bp, Homo sapiens
  misc_feature: 18775.UNK.UNK.UNK.pb.heavy.1.raw 18775
cgtatcgcctcctcgcgccatcagacagtatatacacgccgtgctcgatttagtacacgtgattagggattgggggctttctgagagtcaagacctcctgtgcaagaacatgaagcactgtgttttttcctcctgctggtggcagctcccagatgggtcctgtccaggtgcagctgcagagtcgggccaggactggtgaggccttcgggaaccctgtctctcatctgcactgtctctggagtttccatcagttctgatcattcttgggctggatccggcagccccagggaggggaatggagtgattggtgacatccattatactggggcggacgtactactctccgtccctcaagagtcgtctcaccatttcgagggacacgtccatgaaccggcttctcctgaaactgacctccgtgaccgcgccgcggacacggccgtttatttctgtgcgaggcgagaactggtctttcaatctatggggccgtggcaccctggtcactgtctcctcagcttccaccaagggcccatcggtcttcccctggcgcctgctcaggagcacctctggggcacagcggccctgggctgcctggtcagggactacttcgctatatactgtctgagcgggctggcaaggcgcatag

SEQ ID NO: 790803 - DNA, 611 bp, Homo sapiens
  misc_feature: 18782.UNK.UNK.UNK.pb.heavy.1.raw 18782
ctatgcgccttgccagcccgctcagacagtatataggaagtagtccttgaccaggcagcccagggccgctgtgccccagaggtgctcctgagcagggcgccaggggaagaccgatgggcccttggtggaagctgaggagacggtgaccgtggtcccttggcccagacgtccataccgtagtagtagtatgcaactccccgaactcccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactccatcactattaatacgtgagacccacaccagccccttccctggagcttggcggacccagtgcatccagtagctactgaaggtgaatccagaggctgcacaggagagtctcagggacccccaggctgaactaagcctcccccggactccaccagctgcacctcacactggacaccttttaaaatagcaacaaggaaaacccagctatcagatactaaatcgagcacggtcgtgtatatactgtctgatggcgcgaggaggcgatacg

SEQ ID NO: 790804 - DNA, 659 bp, Homo sapiens
  misc_feature: 18786.44.38.D05.1.pb.heavy.1.raw 18786
cgtatcgcctccctcgcgccatcagacagtatatacacgaccggtgctcgatttagtatctgatagttgggttggggggaagaggaagactgacggtcctccaggagttcagtggctgggcaccttggcacggggaggtgtgtcacaagatttgggctctgggcaccgtgggcatggggaggcttagttcagcctgggggtccctgagactctcctgtgcagcctggatcaccttcagtagctccctggatgcactggttcgccaagctccagggaaggggctggatgtgggtctcacgtattaatagtgatgggagtagcacaagctacgcggactccgtgaagggccgattcacctctccagagacaacgccaagaacacgctgtatctgcaaatgaacagtctgagagccgaggacacggctgtgtattactgtgcaagagcggtgcgggagttcggggagttgcatactactactacggtatggacgtctggggccaagggaccacggtcaccgttctcagcttccaccaagggcccatcggtcttcccctggcgccctgctccagagcaccttctgggggcacagcggcctgggctgccctggtcaaggactacttcctatatacctgtctgagcgggctggcaaggcgcatag

SEQ ID NO: 790805 - DNA, 696 bp, Homo sapiens
  misc_feature: 18800.UNK.UNK.UNK.pb.heavy.1.raw 18800
ctatgcgccttgccagcccgctcagacagtatataggaagtaagtccttgaccaggcagccgagggccgctgtgctctcggaggtgctcctggagcagggcgccagggggaagaccggatggggccctggtggaggctgaggagacggtgaccagggttccgctggccccagtggacagttcctgatataaacacaacacaataatacatgcccgtgtcctcggtttttcaggttagtcattcgcagaatcaatgagttcttgaagtcatctcttgagagggtgaatctggctttcacagacgcggcgtactctgtgataagctggcaactttgtttttactgcggccaagccactccagcccctttccctggagcctggcggacccagtccatatagtggtccactgatggtgaatccagaggcgacacaggagagtctcagggaccctccaggctggacaagtctcccccggactccaccaactgcacttcactctggacaccttgtaaaataacaacaaggaaaacccagctcagcccgaactccaatggtgagtcctctgtgttcagtgctgatcaccaatgaaaacacctgggaattctggggctggggctccgctctcagagctccccaagagagatcgtgacgcagctaatcgagcaccgtcgtgatagggcgcgagggaggcgatacg

SEQ ID NO: 790806 - DNA, 653 bp, Homo sapiens
  misc_feature: 18812.44.86.H09.1.pb.heavy.1.raw 18812
ctatgcgccttgccagcccgcttcagaacagtatataggaaagtagtccttgaccaggcagcccagggccgctgttgcccccagaggtgctcctggagcagggcgccagggggaagaccgatgggcccttggtggaagctgaggagacagtgaccagggtgccacggcccatagattgaaagaccagtctcgcctcgcacagaaataaacggccgtgtccgcggcgtcacggaggtcagtttcagggagaagcggttcatggacgtgtcctcgaatggtgagacgactcttgaggacggagagtagatacgtcgccccagtataatggatgtcaccaatccactccattcccctccctgggggctgccggatccagccccaagaatgatcagaactgatggaaactcagagacagtgcagatgagagacagggttcccgaaggcctcaccagtcctggcccgactcctgcagctgcacctgggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 790807 - DNA, 701 bp, Homo sapiens
  misc_feature: 18838.44.56.F01.1.pb.heavy.1.raw 18838
cgtatcgcctcccctcgcgccatcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagtttttttagaaggtgtccagtgcgaggggcgactggcggagtcgggggggcttggcacagccaggcgccttgagactctcctgtgtagtctcaggattcagtctagtgattatcacttggcctggtcgtcaggctcagggaaggggcttgagtggatcactttcgtcagaatgaaacgttatggtggaagtaaaagagtacgcgcgtctgtgaagggaagattcaccgtctcaaagggatggactccaacagtttggccatttacaaatgagcaacctgagacccgacgacacaaggcgtctatactgcccaggcgatcctgggacgtcgatgcattgatattggggcaggggacaatggtcaccgtctcttcgcttcccaccagagggccatccggtctttccctggcgccctgctccaggagcactctgggggcacagcgccctggctgccggtcaaggactacttcctatatactgtctgagcgggctggcaaggcgcatag

SEQ ID NO: 790808 - DNA, 737 bp, Homo sapiens
  misc_feature: 18848.UNK.UNK.UNK.pb.heavy.1.raw 18848
cgtatcgcctccctcggcgcgccatcagacagtatatacacgaccggtgcttcgatttaggacgcgatcgaagggtttgggggcctgggagacgagcccagcactggaagtcgccggtgttttccactcggtgatcatcactgaacacagaggacctccaccatggagttttggggctgaggctgggttttcctcgttgccccttctttaagaggtgtcatgtgtcaggtgcaattcgtggagtctgggggaggccggtggccccagtagggggggtccctgagactctcctgtgcagccctctggattcaccttcggataattggaaatatgcagtgggtccgccaggctccaggcgaaggcgggctggagtggggtggcaggtgtgtcatttcatggaggaaaatcaagtctacggtgattccgttgaggggccgattcaccatctccagagacaattccgagaacacagtgtctcttcaaaatgaacagcctgagacctcaggacacggccgtggtattttttgtgcgagaactatctgtttccaaaaatcggttcattcgacgcctgggggccaggaacctggtcaccgtctcctcggcctccaccaagggcccatcggtcttccccctggcgccctgctccaggagcacctccgagagcacagcggccctgggctgcctggttcaaggactacttcctatatactgtctgagcgggctggcaaggcgcatag

SEQ ID NO: 790809 - DNA, 669 bp, Homo sapiens
  misc_feature: 18870.44.12.B01.1.pb.heavy.1.raw 18870
ctatgcgccttgccagcccgctcagacagtatataggaagtagtccttgaccaggcagccagggccgctgtgcccccagaggtgctcttggaggagggtgccagggggaagaccgatgggcccttggtggaggctgaggagacggtgaccagggttcctggccccagtggtcaaagtagttggtgacgaaactgccctactctcgcacagtaatacacggccgtgtccgccggcggtcacagagctcagcttcagggagaactggttcttggacgtgtctactgatatggtgactcgactcttgagggacgggttgtagtaggtgctcccactataatagatactcccaatccactccagccccttccctggggggctggcggatccagccccagtagtaactactactgctgatggagccaccagagacagtgcaggtgaggggacagggtctccgaaggcttcaccagtcctgggcccgcgactcctgcagctgcagctgggacaggacccatctgggagccgccacagcaggaggaagaaccacaggtgcttcatgttcttgcacaggaggtccatgactctcagaaagcccccgcggaatctacactactaaatcgagcaccggtcgtgtatatactgtctgatggccgcgagggaggcgatacg

SEQ ID NO: 790810 - DNA, 677 bp, Homo sapiens
  misc_feature: 18874.UNK.UNK.UNK.pb.heavy.1.raw 18874
cgtatcgcctccctcgcgccatcagacagtatatacacgaaccggtgctcgatttagacgcgatcgaagggttttgggggagaggaaagtcgccggtgtttccactcggtgatcatcactgaacacagaggactcaccatggatttgggctgagctggttttcctcgttgccctcttaagaggtgtcatgtgtcaggtgccattcgtgagtctgggggaggcgtggcccagtagggggggtccctgagactctcctgtgcagcctctggattcaccttcgataattggaatatgcagtgggtccgccaggctccaggcgaggctggagtgggggcaggtgtgtcattcatggaggaaatcaagtctacggtgattccgttgaggccgattcaccatctccagagacaattccgagaacacagtgtctcttcaaatgaacagcctgagacctcaggacacggccgtgtatttttgtgcgagactatctgtttccaaatcggttcattcgacgcctggggccagggaaccctggtcaccgtctcctcggcctcaccaagggcccatcggtcttccccctggcgccctgctccaggagcactccgagagcacagcggccctggctgcctggtcaaggactacttcctatatactgtctgagcgggctggcaggcgcatag

SEQ ID NO: 790811 - DNA, 657 bp, Homo sapiens
  misc_feature: 18890.UNK.UNK.UNK.pb.heavy.1.raw 18890
cgtatcgcctcctcgcgccatcagacagtatatacacgaccgtgctcgatttagtgagtcagtaaggaaaggggctgggagaggagcccagcactagaagtcggcgtgttccattcggtgatcagcactgaacagaggactcaccatggagtttgggctgagctggtttcctcgttgctcttttaagaggtgtcagtgtcaggttcagctggtggagtctggggaggcgtggtccagcctggacgtcctgagactctcctgtgtgcgtccggactcagtttcagtgactctgccatgcactgggtccgccaggctccaggcaaggggctggagtgggtggcagtcatctgtctgatggaagtaaagaatactatggaaactccgtgaagggccgattctccgtctccgagacaattccaagaacacgtgtatctacaaatgaacaatttgagagccgagactcggctctctatattgtacgagccatcgttctactgggccagggagccctggtcaccgtctcctcagcctccaccaaggcccatcggtcttcccctggcgccctgctcaggagcacctccgagagcacagcgccctgggctgcctggtcaaggactacttcctatatactgtctgagcgggctggcaggcgcatag

SEQ ID NO: 790812 - DNA, 651 bp, Homo sapiens
  misc_feature: 18910.44.86.H09.1.pb.heavy.1.raw 18910
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgccgcggtcacggaggtcagtttcagggagaagcggttcatgacgtgtcctcgaaatggtgagacgactcttgagggacggagagtagtacgtcgccccagtataatggatgtcaccaatccactccattcccctccctgggggctgccggatccagcccaagaatgatcagaactgatggaaactccagagacagtgcagatgagagacagggttcccgaaggcctcaccagtcctggcccgactcctgcagctgcacctgggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 790813 - DNA, 670 bp, Homo sapiens
  misc_feature: 18921.UNK.UNK.UNK.pb.heavy.1.raw 18921
cgtatcgcctccctcgcgccatcagacaagtatatacacgaccggtggctcgatttagtagtgtagattccgcgggggctttctgagagtcatggacctcctgtgcaagaacatgaaagcacctgtggttcttcctcctgctggtggcggctcccagatggggtcctgtcccagctgcagctgcaggagtccggggcccaggactggtgaagccttcggagaccctgtccctcacctgcactgtcttctggtggctccatcagcagtagtagttactactggggctggatccgccagcccccaggaagggggctggagtggattgggagtatctattatagtgggagcacctactacaacccgtccctcaagagtcgagtcaccatatcagtagacacgtccaagaacagttctccctgaagctgagctctgtgaccgccgcggacacggccgtgtattactgtgcgagagtagggccagttcgtcaccaactactttgaccactggggccagggaaccctggtcaccgtctcctcagcctccaccaagggcccatcggtcttccccctggcaccctcctccaagagcacctctggggggcacagcggccctgggctgcctggtcaaggactacttcctatatactgtctgagcgggctggcaaggcgca

SEQ ID NO: 790814 - DNA, 726 bp, Homo sapiens
  misc_feature: 18936.44.85.H08.1.pb.heavy.1.raw 18936
ctatgcgccttgccagccccccgctcagacagtatataggaagtagtccttgaccaggcagcccagggccgctgtgccccagaggtgctcttggaggagggtgccagggggaagaccgatgggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctcccccagactccaccagctgcacctgacactggacacctcttaaaagagcaacgaggaaaacccagctcagcccaaactccatggtgagtcctctgtgttcagtgctgatcaccgaatggaaaacaccgccgacttctagtgctgggctcctctcccagagctccccgcgactgagtgatactaaatcgagcaccggtcgtgtatatactgtctgatggcgcgagggaggcgatacg

SEQ ID NO: 790815 - DNA, 593 bp, Homo sapiens
  misc_feature: 18939.44.78.H01.1.pb.heavy.1.raw 18939
cgtatcgcctccctcgcgccatcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccggctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790816 - DNA, 591 bp, Homo sapiens
  misc_feature: 18962.UNK.UNK.UNK.pb.heavy.1.raw 18962
gaaggctggcaggctatgcaccctggtccaggtcaaagctgcggaacccgctagcgccatcttggccactaggggtcccgcagattcatattgtcgtctagcatgcacaatgctgcaaacccagcttgcatgcccacagcaagcggccaatcttacgccacgttgaatgtttattacctgtgactggctatggcttgcaacgcactcgtaaaactagtactttgcggttaggggaagtagacaaacccattactccacttcccggaagttcaactcattccaacacgaaataaaagtaaactcaaccccaagcaggctatgtggggggtgataggggtggattctatttcctatcccatccctaggatctcaattaagttactagcgagttaaatgctgtagcgatccgtcagtctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtcctagctccaagtcctacaagcgtgtcggg

SEQ ID NO: 790817 - DNA, 589 bp, Homo sapiens
  misc_feature: 18995.44.78.H01.1.pb.heavy.1.raw 18995
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggccccacaagtcaagccaggtgctgtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggcttcttcacctcagccccagactgcaccagctgtacctgggagtgggaccgtcagtcttcctcttccccccaaaccaaactactcacactaaatcgagcaccggtcgtgtatatactgtctgatggcgcgagggaggcgatacg

SEQ ID NO: 790818 - DNA, 609 bp, Homo sapiens
  misc_feature: 19008.UNK.UNK.UNK.pb.heavy.1.raw 19008
cgtatcgcctcctcgcgccatcagacagtatatacacgaccgtgctcgatttagtatctgatagctgggtttccttgtgctattttaaaaggtgtccagtgtgaggtgcagctggtggagtccgggagcttagttcagcctgggggtccctgagactctcctgtgcagcctctggattcaccttcagtagctactggatgcactgggtccgccaagctcaggaaggggctggtgtgggtctcacgtattaatagtgatgggagtagcacaagctacgcggactccgtgaagggccgattcaccatctcagagacaacgcaagaacacgctgtatctgcaaatgaacagtctgagagccgaggacacggctgtgtattactgtgcaagagccggtgcgggagttcggggagtgcatactactactacggtatggacggtctgggggccaaggggaccacgtcaccgtctctcagcttccaccaagggcccatcggtcttccccctggcgccctgctcaggagccacctctgggggccacagcggccctgggctgccctgtcaaggactacttctatatactgtcctgagcgggctggcaaggcgcataga

SEQ ID NO: 790819 - DNA, 703 bp, Homo sapiens
  misc_feature: 19014.44.67.G01.1.pb.heavy.1.raw 19014
ctatgcgccttgccagcccgctcagacagtatataggaagtagtccttgaccaggcagccagggccgctgtgcccccagaggtgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaacgtgttcctggaattgtccctggagatggtgaatcggccttcacggagtctgcgtagtatgtgaaatcaccagtataaatgactgagacccactccagccccttccctggagcctggcggacccaactcatgtagttgctgctgacggtgagcccagaggctgcacaggagagtctctggggacccccaggctggactaagcctcctccagactccatcagccgcacctcacactggacaccttttaaaagtccaacaaggagaaccccagctcagccaaaactccatggtgagtcctctgtgttcagtgctgatcaccgaatggaaacacctcggaatccagtgctgggctcctctcccccccaaacccaatatgtatactctaaatcgagcaccggtcgtgtatatactgtctgatggcgcgagggaggcgatacg

SEQ ID NO: 790820 - DNA, 712 bp, Homo sapiens
  misc_feature: 19031.UNK.UNK.UNK.pb.heavy.1.raw 19031
ctatgcgccttgccagccgctcagacagtatataggaaagtagtccgttgaccaggcagcccagggccgctgtgccccagaggtgctcctggagcaggcgccagggggaagaccgatgggccccttggtgaagctgaagagacggtgaccattgtccctggccccaaatatcaaatgcatcgacgacgtcccaggactgctggcgcagtaatagacgcctgtcgtcgggtctcaggttgctcatttgtaaatgggccaacactgtggagtcatcccttgagacggtgaatcttcccttcacagacgcggcgtactcttacttccaccataacgtttcattctggacgaaagtgatccctcaagccccttccctggagcctgacggacccaggcaagtgactaatcactaagactgaatccctgagactacacagagagtctcagagacccgccgctgttgccgccaagcccccccgactccgccagtcgcccctcgcactgacaccttctaaaaaaactacaaggaaaatcaaagattagcccaaaactccatggttggtggtctgtgctcagtgctgatcaccaagtgaaactcctgggaatctcacggctggggctcctctccagagctcccctttgctgtgttcagacgtctgctaaatcgagcaccgtcgtgatatatactgtctgatggcgcgagggaggcgatacg

SEQ ID NO: 790821 - DNA, 690 bp, Homo sapiens
  misc_feature: 19067.UNK.UNK.UNK.pb.heavy.1.raw 19067
ctatgcgccttgccagcccgctcagacagttataggaagtagtccttgaccaggcagcccagggccgctgtgcttcggaggtgccctggagcaggcgccagggggaagaccgatgggcccttggtggaggccgaggaagacggtgaccagggttccctggccccaggcgtcgaatgaaccgattttggaaacagatagtctcgcacaaaaatacacggccgtgtcctgaggtctcaggctgttcatttgaagagacactgtgttctggaattgtctctggagatggtgaatcggccctcaacggaatcaccgtagacttgatttcctccatgaaatgacacacctgccacccactccagccctcgcctggagcctggcggacccactgcatatttccaattatcgaaggtgaatccagaggctgcacaggagagtctcagggacccctactgggccacgccacctcccccagactccacgaattgccctgaccatgacacctcttaagaggcaacgaggaaaacccagctcagcccaaactccatggagtctctgtgttcagtgatgatcaccgagtggaaacaccggcgacttccagtgctgggctcgtctcccagccccaaaccttcgatcgcgtctatcgagcaccggtcgtgtatatactgtctgatggcgcgaggaggcgatacg

SEQ ID NO: 790822 - DNA, 697 bp, Homo sapiens
  misc_feature: 19074.44.55.E11.1.pb.heavy.1.raw 19074
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttcctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagcccttcctggagcctggcggacccaactcatgtagttgctgctgacggtgagccagaggctgcacaggagagtctctgggaccccccaggctggactaagcctcctccagactccatcagccgcacctcacactggacacctttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaaatcgagcaccggtcgtgtatatactgtctgatggcgcgagggaggcgatacg

SEQ ID NO: 790823 - DNA, 601 bp, Homo sapiens
  misc_feature: 19076.UNK.UNK.UNK.pb.heavy.1.raw 19076
cgtattcgcctcctccggcgccatcagaccagtatatacacgaccgtgctcgatttagctgcgtcacgatctctcttcgggtttgtcccaggtcacctgaaggagtctggtcctgtgctggtgaaacccacagagaccctcacgctgacctgcaccatctctggttctctctcaacgatatagaatggtgtgagctggatccgtcagcccccagggaaggccctggagtggcttgcacacatcttctcgaatgacgaaaaatcctacagtacatctctgaagagcagtttaaccatctccaaggacacctccaaaaggcagtggtctttagtatgaccaacatggaccctgcggacacaggcacatattactgtgcacgggtaatgcgggaaagaaacagctggtttctgtattataagtcttacatctggacgtctggggcaagggaccacggtcaccgtctcctcagcttccacaagggcccatcggtcttccccctggcgccctgctccaggagcacctctggggccacagcggcctgggctgcctggtcaaggactacttcctatatactgtctgagcgggctggcaaggcgcatag

SEQ ID NO: 790824 - DNA, 703 bp, Homo sapiens
  misc_feature: 19079.44.36.D03.1.pb.heavy.1.raw 19079
ctatgcgccttgccagcccgctcagacagtattaggaagtagtccttgaccaggcagcccaggccgctgtgctctcggaggtgctcctggagcagggcgccaggggaagaccgatgggcccttggtggaggctgaggagaccggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggacctccaggctggaccaagtctcccccggactccaccaactgcacttcactctggacaccttgtaaaataacaacaaggaaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 790825 - DNA, 626 bp, Homo sapiens
  misc_feature: 19094.44.23.C01.1.pb.heavy.1.raw 19094
ctatgcggccttgccagccgccctcagacagtatataggaaagtagtccttgaccaggcagccagggccgctgtgcccccagaggtgctcctggagcagggcgccagggggaagaccgatgggcgcccttggttggaagctgaggagacagtgaccagggtgccacggccccatagattgaaagaccagtctcgcctcgcacagaaataaacggccgtgtccgcgcggtcacggaggtcagtttcagggagaagcggttcatggacgtgtcctcgaaatggtgagacgactcttgaggacgggagtagtacgtcgccccagtataatggatgtcaccaatccactccattcccctccctggggggctgcccggatccagccccaagaatgatcagaactgatggaaactccagagacaggtgcagatgagagacagggttcccgaaggcctcaccagtcctgggcccgactcctgcagctgcacctgggacaggacccatctgggagctgccaccagcaggaggaaaaaccacaggtgttcaccctgccccaatccctaatcacgtgtactaaatcgagcaccggtcgtgtatatactgctctgatggcgcgagggaggcgatacg

SEQ ID NO: 790826 - DNA, 700 bp, Homo sapiens
  misc_feature: 19096.44.36.D03.1.pb.heavy.1.raw 19096
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtgggagtccgggggagacttggtccagcctggagggtccctgagactctcctgtgtcgcctctggattcaccatcagtgaccactatatggactggtcgccaggctccagggaaggggctggagtggcttggccgcagtaaaaacaaagtgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactgggccagggaaccctggtcaccgtctcctcagcctccaccaaggcccatcggtcttcccctggcgccctgctccaggagcacctccgagagcacagcggccctgggctgcctggtcaaggactacttcctatatactgtctgagcgggctggcaaggcgcatag

SEQ ID NO: 790827 - DNA, 705 bp, Homo sapiens
  misc_feature: 19112.44.55.E11.1.pb.heavy.1.raw 19112
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgacagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccaggccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaactccatggtgagtcctctgtgttcagtgctgatcaccgaatggaaacacctcggaatccagtgctgggctcctctcccccccaaacccaacgtgcgagtgctaaatcgagcaccggtcgtgtatatactgtctgatggcgccggaggaggcgatacg

SEQ ID NO: 790828 - DNA, 681 bp, Homo sapiens
  misc_feature: 19121.UNK.UNK.UNK.pb.heavy.1.raw 19121
cgtatcgcctccctcagcgccatcagacagatatacacgacgtgctcgatttagcactcgcacgttgttgggggggagaggagcccagcactgggattcgaggtgtttccattcgtgatcagcaactgaacacagaggactcaccatggagtttggctgagctgggttctccttgttggacttttaaaaggtgtccagtgtgaggtgcggctgatgagtctggaggaggcttagtccagcctgggggtccagagactctcctgtgcagcctctgggctcaccgtcagcagcaatacatgagttggtcgccaggctccaggaaggggctggatgggtctcagtcatttatactggtgattttcacatactacgcagactccgtgaagggccgatcaccatctccaggacaattccaggacacggtttatcttcaaatgaacaacctgagagcgacgacacggccgtctattactgtgcgagacaagtcggcgctcgagtggttattattcgtttgacttctggggccaggaaccctggtcaccgtcgcctccgcctccaccaagggccatcggtcttccccctggcaccctcctcaagagcactctggggcacagcggcctgggctgcctggtcaaggactacttcctatatactgtctgagcgggctggcaaggcgcatag

SEQ ID NO: 790829 - DNA, 698 bp, Homo sapiens
  misc_feature: 19128.UNK.UNK.UNK.pb.heavy.1.raw 19128
cgtatcgcctcctcgcgccatcagacagtatatacacgacggtgctcgatttagctctacgctcaggggagctctggagaggagcccagcactagaagtcggcggggtgttccattcggtgatcagcactgaacacagaggactcaccatggagtttgggctgagctgggtttcctcgttactccttttaagaggtgtccagtgtcagtgcacctggtggagtctgggggaggcgtggtccagcctgggaggtccctgagactctcctgtgaagcctctggatttagtttcagtagttctggcatgcactggtccgccaggctccaggcaagggccggagtggttggcagttatagcatatgatggaacttctagatattatgcagactccgtgaagggccgattcaccatctccagagacaattcccggaacactctgtacctggaaatgacagcctgagaggcgaggactcggctctgtattactgtgcgagatcgggaagtggcagcagctattatcgggcgtttcactggggccaggggacactggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 790830 - DNA, 703 bp, Homo sapiens
  misc_feature: 19149.44.55.E11.1.pb.heavy.1.raw 19149
ctatgcgccttgccagcccgctcagacagtatataggaagtagtccttgaccaggcagccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcaggccaaaactccatggtgagtcctctgtgttcagtgctgatcaccgaatggaaacacctcggaatcccagtgctgggctcctctccccaaacccaacgtgcgagtgctaaatcgagcaccggtcgtgtatatactgtctgatggcgcgagggaggcgatacg

SEQ ID NO: 790831 - DNA, 739 bp, Homo sapiens
  misc_feature: 19189.UNK.UNK.UNK.pb.heavy.1.raw 19189
ctatgcgccttgccagcccgctcagacagtatataggaagtagtccttgaccaggcagcccagggccgctgtggcccccagaggtgctcttggaggagggtgccagggggaagaccgatgggccccttggtggagggctgaggagacggtgaccgtggtcccttggccccagacgtccataccgtagtagtagttcccagcaggtgggtagtactacaatatgtcctcgcacagtaatacacagccgtgtcctcggctctcaggctgttcatttgcagatacagcgtgttccttggaattgtctctgggagatggtgaatccggcccttcacggagtctgcatagtatttattactttccatcataccatataagtgccacccactccagcccccttgcctggagccggcggacccagtgcatgccatagggtactgaaggtgaatccagacgctgcacaggagagtctcccagggacctccccaggctggaccacgcctccccagactccaccagctgcacctgacactgcgacacctcttaaaagagcaacgaggaaaacccagctcagcccgaaactccatggtgagtcctctggtgttcagtgctgatcaccgaatggaaacaccgccgacttctagtgctgggctcctctccccccccccgccgactgagtgatactaaatcgagcaccgggggtcgtgtatatactgtctgatggcgcgagggaggcgatacg

SEQ ID NO: 790832 - DNA, 672 bp, Homo sapiens
  misc_feature: 19221.UNK.UNK.UNK.pb.heavy.1.raw 19221
ctatgcgccttgccagcccgctcagacagtatataggaagtagttccttgaccaggcagcccagggccgctgtgccccagaggtgctcttgggaggaggtgccagggggaagaccgatggggcccttggtggaggctgaggagacggtgaccagggttccctggcccagtggtccaaagtagttggtgacgaactgccctactctccgcacagtaatacacggccgtgtccgcggcggtcacagagctcagcttcagggagaactggtcttggacgtgtctacctgatatggtgactcgactcttgaggacgggttgtagtaggtgctccccactataaatgatactcccacaatccactccagccccttccctgggggggctggcggatccagccccagtagtaactactactgctgatggagccacccagagacagtgcagggtgagggacagggtctccgaaggcttcaccagtcctgggcccgactcctgcagctgcagctggggacaggacccatctgggagccgccaccagcaggaggagaaccacaggtgcttcatgttcttgcacaggaggtccatgactctcagaaaagccccgcggaatctacactactaatcgaggcaccggtcgtgtataacctgtctgatggcgcgaggaggcgatacg

SEQ ID NO: 790833 - DNA, 718 bp, Homo sapiens
  misc_feature: 19252.UNK.UNK.UNK.pb.heavy.1.raw 19252
ctatgcgccttgccagcccgctcagacagtatataggaagtagtccgttgaccaggcagcccagggccgctgtgcccccagaaggtgctcttggaggaggtgccaggggaagaccgatggcccttgtggaggcggaggcgacggtgaccagggttccctggccccagaagtcaaacgaataataaaccactccgagccgccgacttgtctcgcacagtaatagacgccgtgtcgttcgcgcctctcaggttgttcatttgaagactaaaccgtgttcctggaattgtccctggagatgggtgaatcggcccttcacgggagtctgcgtagtatgtgaaatcaccagtcataaaatgactgagacccactccagccccttcctggagcctggcggacccaactcatgtagttgctgctgacggtgagcccagaggctgcacaggagagtctctgggacccccccaggctggactaagcctcctccagacctccatcagccgcacctcacactgcgacaccttttaaaagtccaacaaggagacccagctcagccaaaactcctgcgtggcgtcccgtcctctgtgttccagtgctgatcaccgaatggaaacacctcgggaatcccagtgctggggcctcctctccccaaaccaacggtgcgagtgctaatcgagcaccggcgtgtatatactgtctgatggcgcgaggaggcgatacg

SEQ ID NO: 790834 - DNA, 638 bp, Homo sapiens
  misc_feature: 19259.44.86.H09.1.pb.heavy.1.raw 19259
cgtatcgcctccctcgcgccatcagacagtatatacacgaccggtgctcgatttagtgctatagacttgggtttggggatgctttctgagagtcaagacctcctgtgcaagaacatgaagcacctgtggtttttcctcctgctggtggcagctcccagatgggtcctgtcccaggtgcagctgcaggagtcgggcccaggactgtgaggccttcgggaaccctgtctctcatctgcactgtctctggagtttccatcagttctgatcattctggggctgggatccggcagcccccagggaggggaatggagtggattggtgacagtcccatatactggggcgacgactactctccgtcctcagatcgtctcaccattctcgagggacacgtcatgaaccgccttctccctgaaactgacctcctgacccgccgcggacacggccgttatttctgtgcgaggcgagactgtctttcatctatgggccgtggcaccctgtcactgtctctcagcttcaccaagggcccatcggtcttccccggcgccctgctccaggagcacctctgggggcacagcgcccctgggctgcctgtcaagactacttcctatatactgtctgagcgggctggcaaggcgcat

SEQ ID NO: 790835 - DNA, 623 bp, Homo sapiens
  misc_feature: 19278.44.36.D03.1.pb.heavy.1.raw 19278
ctatgcgccttgccagcccgctcagacagtatataggaagttagtccttgaccaggcagcccagggccgctgtgccccccagaggtgctcctggagcaggcgccagggggaagaccgatgggcccttggtggaagctgaggagacggtgaccgtggtccctttgccccagacgtccagaatggtaagacttataatacagaaaccagctgtttctttcccgcattacccgtgcacagtaatatgtgcctgtgtccgcagggtccatgttttggtcatactaaagaccacctgccttttggaggtgtccttggagatggttaaactgctctttcagagatgtaactgtaggatttttttcgtcattcgagaagatgtgttgcaagccactccagggccttccctgggggctgacggatccagctcacacccattctaatatcgtttgagaagaaacccagaagatggtgcaggtcagcgtgagggtctctgtgggtttcaccagcacagaccagacccttcaaggtgaacctgggacaagacccaaagaagaggatcgtgacgcagctaaatcgagcaccggtcgtgtataataactgtctgatggcgcgagggaggcgatacg

SEQ ID NO: 790836 - DNA, 693 bp, Homo sapiens
  misc_feature: 19298.44.73.G07.1.pb.heavy.1.raw 19298
ctatgcgccttgccagcccgctcagacagtatataggaagtagtccttgaccaggcagcccagggccgctgtgctctcggaggtgctcctggagcagggcgcccaggggaagaccgatgggcccttggtggaggctgaggagacggtgaccagggttccctggccccagtagtcaagcgggaccgtctcgagggggctctcgcacaataatagacagccgtgtcctcacttgtgaggttgtacatttgcagatgcagtgtgttcctggaattgtctctggagacggtgaatcggcccttcttcggagtctccgtagtgttcttcaattccatcttctgatataattgccacccactccagccccttgcctggagcctggcggaccagtgcatggcataggtcctgaagattgaatccagaggctgcacaggagagtctcagggagttcccaggctgggccgctcctcccccagactccactagctgcacctgacactggccacctctttaaaagagcaacgaggaaaacccatctcagcccaaagtccatggtgagtcctctgtgttcagtgatgatcaccgaatggaaacaccggcgacttccagtgctgggctcgtctcccccctgagcgtagagctaaatcgagcaccggtcgtgtatatactgtctgatggcgcgagggaggcgatacg

SEQ ID NO: 790837 - DNA, 705 bp, Homo sapiens
  misc_feature: 19301.44.36.D03.1.pb.heavy.1.raw 19301
cgtatcgcctccctcgcgccatcagacagtatatacacgaccggtgctcgatttagctgcgtcacgatctctcttgggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgttttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790838 - DNA, 651 bp, Homo sapiens
  misc_feature: 19303.44.57.F02.1.pb.heavy.1.raw 19303
cgtatcgcctccctcgcgccatcagacagtatatacacgaccggtgctcgatttagctcgatatagttgggtttgggatgctttctgagagtcaaggacctcctgtgcaagaacatgaagcacctgtggtttttcctcctgctggtggcagcctcccagatgggtcctgtccccaggtgcagctgcaggagtcgggcccaggactggtgaggccttcgggaaccctgtctctcatctgcactgtctctggagtttccatcagttctgatcattcttggggctgatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttattctgtgcgaggcgagactggtctttcatctatgggccgtggcaccctggtcactgtctcctcagcttccaccaaggggcccatcggtcttcccctggcgccctgctccaggagcacctctgggggcacagcggccctgggctgcctggtcaaggactacttcctatatactgtctgagcggctggcaaggcgcatag

SEQ ID NO: 790839 - DNA, 705 bp, Homo sapiens
  misc_feature: 19304.UNK.UNK.UNK.pb.heavy.1.raw 19304
ctatgcgccttgccagcccgctcagacagtatataggaagtagtccttgaccaggcagcccagggcgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgttgaaatcaccagtataaatgactgagacccactccagccccttccctgggcctggcggacccaactcatgtagttgctgctgacgggtggagcccagaggctgcacaggagagtctctggaccccaggctggactaagcctctccgactccatcagcccgcacctcacactggacaccttttaaaagtccaacaaggagaacccagctcagccaaaactccatggtgagtcctctgtgttcagtgctgatcaccgaatggaaacacctcggaatcccagtgctgggctcctctcctccccaaaccaatattatacctctaaatcgagcaccggtcgtgggtatatactgtctgatgggcgcgagggaggcgatacg

SEQ ID NO: 790840 - DNA, 644 bp, Homo sapiens
  misc_feature: 19308.44.86.H09.1.pb.heavy.1.raw 19308
ctatgcgccttgccagcccgctcagacagtatataggaagtagtccttgaccaggcagcccagggcgctgtgccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcaggagaagcggttcatggacgtgtccctcgaaatggtgagacgactcttgagggacggagagtagtacgtcgcccagtataatggatgtcaccaatccactccattcccctccctgggggctgccggatccagcccaagaatgatcagaactgatggaactccagagacagtgcagatgagagacagggttcccgaaggcctcaccagtcctggcccgactcctgcagctgcacctgggacaggacccatctggagctgccaccagcaggaggaaaaccacaggtgcttcatgttcttgcacaggaggtccttgactctcagaaagcatccccaaacccaagtctatagcactaatcgagcaccggtcgtgtatatactgtctgatggcgcgagggaggcgatacg

SEQ ID NO: 790841 - DNA, 705 bp, Homo sapiens
  misc_feature: 19326.44.56.F01.1.pb.heavy.1.raw 19326
cgtatcgcctccctcgccgccatcagacagtatatacacgaccggtgctcgatttagcagacgtctgaacacacaaaggggctggagaggagccccagccgtgagattcccaggagtttccacttggtgatcagcactgagcacagaccaccaaccatggagtttgggctaatcttgatttccttgtagtttttttagaaggtgtccagtgcgagggggcgactggcggagtcggggggggcttggcacagccagggcggtctctgagactctcctgtgtagtctcaggattccagtcttagtgattatcacttggcctgggtccgtcaggctccagggaaggggcttgagtggatcactttcgtcagaatgaaacgttatggtgaagtaaagaggtacgccgcgtctgtgaaggaagattcaccgtctcaagggatgactccaacagtgttgccatttacaaatgagcaacctgagacccgacgacacagcgtctattactgcgccaggcgatcctgggacgtcgatgcatttgatatttggggccagggacaatggtcaccgtctcttcagcttccaccaaagggcccatcggtcttccccctggcgccctgctccaggagcacctctggggcacagcggccctgggctgctggtcaggactacttcctatatactgtctgagcgggctggcaaggcgcatag

SEQ ID NO: 790842 - DNA, 705 bp, Homo sapiens
  misc_feature: 19330.44.36.D03.1.pb.heavy.1.raw 19330
cgtatcgcctccctccgcgccatcagacagtatatacacgaccggtgctcgatttagctgcgtcacgatctctcttggggagctctgagagcggagccccagcccagaattcccaggtgttttcattggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgcccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790843 - DNA, 677 bp, Homo sapiens
  misc_feature: 19341.44.72.G06.1.pb.heavy.1.raw 19341
cgtatcgcctccctcgcgccatcagacagtatatacacgaccggtgctcgattagctacgactgcaagggaaaggggagagaggagccttagcctggactccaaggcctttccacttggtgatcagcactgagcacagaggactcaccatggaattgggactgagctgggttttctttgttgctattttaaaggtggtccagtgtgaggtgcaaactggtggagtctgggggaggctggtcccagcctgggggtccctgagactctcctgtgcagctctggattcacctttagtagttattgatgaactgggtccgccaggctccaggaagggctggagtgggtgccatcatgaagaaagatggaactgagacacactatgtggactctgtgaagggccgattcaccatcctccagagacaacgccaagaactcactgtatctgcaaatgaacagtctgagagtcgaggacacggctgtgtattattgtgcgggagcgctggtgctcattgactactggggtcagggaaacctgtcaccgtctcctcagcctccaccaaggcccatcggtcttccccctggcgcctgctccaggagcacctccgagagcacagcggccctggctgcctgtcaagactacttctatatactgtctgagcgggctggcaaggcgcatag

SEQ ID NO: 790844 - DNA, 662 bp, Homo sapiens
  misc_feature: 19347.44.73.G07.1.pb.heavy.1.raw 19347
cgtatcgcctccctcgcgccatcagacagtatatacacgaccggtgctcgatttagctctacgctcaggggggggagacgagccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggaggagcggcccagcctgggaactccctgagactctcctgtgcagccttctggattcatcttcaggacctatgccatgcactgggtccgccaggctccaggcaaggggctggagtgggtggcattatatcagaagatggaattgaagaacactacggagactccgagaagggccgattcaccgtctccagagacaattccaggaacacactgcatctgcaaatgtacaacctcacaagtgaggacacggactgtctattattgttgcgagagcccctcgagacggtcccgctttgactactggggccagggaaccctggtcaccgtctcctcagcctccaccaaggcccatcggtcttccccctggcgccctgctccaggagcacctccgagagcacagcggcccttggctgcctggtcaaggactacttcctata

SEQ ID NO: 790845 - DNA, 689 bp, Homo sapiens
  misc_feature: 19355.44.74.G08.1.pb.heavy.1.raw 19355
cgtatcgcctccctcgcgccatcagacagtatatacacgaccggtgctcgatttagtagctctatcaggggagcatcacataacaaccacattcctcctctaaagaagcccctgggagcacagctcatcaccatggactggacctggaggttcctctttgtggtggcagcagcaacaggtgtccagtccctggtgcaactggtgcagtctggactagaatgccgcaaccttggtcctcggtgaccctttcctgcacggcctctggaagtactaccagttccactacttataccatcaactgggtgcgcaggcccctggacaagggcttgagtggatgggtggaatcatccctcttttggctccactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcacctcagcttccaccaagggcccatcggtcttcccctggcgccctgctccaggagcacctctgggggcacagcggccctgggctgcctggtcaaggactacttcctatatactgtctgagcggctggcaaggcgcatag

SEQ ID NO: 790846 - DNA, 676 bp, Homo sapiens
  misc_feature: 19390.44.6.A06.1.pb.heavy.1.raw 19390
cgtatcgcctccctcgcgccatcagacagtatatacacgaccggtgctcgatttagatctactgacaaccacgattcctcctctaaagaagccctgggagcacagctcatcaccatggactggacctggaggttcctctttgtggtggcagcagcaacaggtgtccagtccctggtgcaactggtgcagtctggggactagaatgccgcaaaccttggtcctcggtgaccctttcctgcacggcctctggaagtactaccagttccactacttataaccatcaactgggtgcgccaggccctggacaagggcttgagtggatgggtggaatcatccctcttttggctcactcacctacgcacgagacttccggggcagaattacgattaccgcggacaagtccacagacacagtctccatgacaatgagttctttgaaatccgacgacacggccgtctactactgtgcgagagtccgtaccccagctcgcatggagcctttgagatctggggggcaggggaaccctggtcattgtcacctcagcttccaccaagggcccatcggtcttcttggcgcccctgctccaggagacctctgggggcacagcggccctgggctgcctggtcaaaaggactacttcctatatactgtctgagcgggctggcaaggcgcatag

SEQ ID NO: 790847 - DNA, 734 bp, Homo sapiens
  misc_feature: 19449.44.56.F01.1.pb.heavy.1.raw 19449
ctatgcgccttgccagcccgctcagacagtatataggaagtagtccttgaccaggcaagcccagggccgctgtgcccccagaggtgctcctggagcagggcgccagggggaagaccgatggggccccttggtggaagctgaagagacggtgaccattgtcccctggccccaaaatatcaaatggcatcgacgtcccaggatcgcctggcgcagtaatagacgcctgtgtcgtccgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctgggaggcctgacggacccaggccaaaagtgataatcactaaagactgaatcctgagactacacaggagagtctcagagaccgccctggctgtgccaagccccccccgactccgccagtcgcccctcgcactggacaccttctaaaaaaactacaagaaaatcagattaggcccaaaaactccatggtttggtggtctgtgcctccagtgctgatcacccaaagtggaaactcctgggaatctcacggctggggctgcctctcccagagcttcccctttgtgtgttcagacgtctgctaaatcgagcaccggtcgtgtatatactgtctgatggcgccgagggaggcgatacg

SEQ ID NO: 790848 - DNA, 719 bp, Homo sapiens
  misc_feature: 19462.UNK.UNK.UNK.pb.heavy.1.raw 19462
cgtatcgcctcccctcggcgccattcagacagtataatacacgaccggtgctcgatttagctcttacgctcagggggggggagacgagcccagcactggaagtcgcccggtgtttttccattcggtgatcatcactgaacacagaggactcaccatggacttttgggctgagatgggtttttcctcgtttgctctttttaagaggtggccagttgtcaggtgcagctagtgggagtctgggggaggagcggcccagcctgggaaactccctgagactcctcctgtgcagcctctggatttcatcttcaggacctatgccatgcactgggtccgccaggctccaggcaaggggctggagtgggtggcaattatatcaagaagatggaattgaagaacactacggagactccgagaaagggccgattcaccgtctccagagacaaatttccaggaaacacactgcatctgcaaatgtacaacctcacaaagtgaggacacggctgtcttattattgtgcgagaagccccctcgagacggtccccgcttgactactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcggctggcaaggcgcatag

SEQ ID NO: 790849 - DNA, 1045 bp, Homo sapiens
  misc_feature: 19478.UNK.UNK.UNK.pb.heavy.1.raw 19478
cgttatcgcctcctcgcgccatcagacagtatataacacgaccggttgctcgatttagtgtgagttagttttgggtttgggggaagaggaagactgacggttcccactcccaggtacagctggtgcagtctggggctgaggtgaaaagaagcctggggcctcagtgacagtcttcctgcacggcttcttggatacacgtttcatcaattatgaatattaactgggtgcgacaggccgctggacaagggctggagtggatgggatggatgaagccctatagtggcaacacgggctttgcccagaaagttccaaggcagagttagtatgaccaggagcacctcccaggtacagtctacatggaactgagcagcctgaagatctggaggacacggccgtggtatttctgtgcgagagccaccagcacctggctttgacttgtggggccagggaaccctggtcaccgtctcctcagcctccaccaagggcccatcggtcttccccctggcgcccctgctccaggagcacctccgagagcacagcggcccctgggccttgcctgggtcaaggactacttcctatatactgtctgagcgggctggcaaggcgcatagcgtatcgcctccctcgcgccatcagacagtatataacacgaccggtgctcgatttagtgagtcgtaagggaaagggctggagtggggtggcagtcatctggtcctgaatggaagtaaaggaaatactatggaaactccgtgaaagggccgattctccgtctccagagacaattccaagaacaccgtgtatctacaaatgaaaacaatttgaaggagccgagactcgctcttcttatttattgttacgagcccatcgttctactggggccagggagccctggtcaccgtctcctcaagcctccaccaagggccatcggtcttccccctggcgccctgctccaggagcacctccgagagcacagcggccctgggctgcctggttcaaggactacttccttaattactgtctgagcgggctggcaaaggcgcaatag

SEQ ID NO: 790850 - DNA, 689 bp, Homo sapiens
  misc_feature: 19482.UNK.UNK.UNK.pb.heavy.1.raw 19482
ctatgcggccttgccagcccgctcagacagtatataggaagtagtccttgaccaggcagcccagggccgctgtgctctcggaggtgctcctggagcagggcggccagggggaagaccgatggggcccttggtggaggctgaggagacggtgaccagggcctccctgggccccagtagaacgatgggctcgtacaataatagagagccgagtcctcggctctcaattgttcatttgtagatacacggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcagggacgtcccaggctggaccacgctccccccagactccaccagctgaacctgacactgggacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactccactaaatcgagcaccggtcgtgtatatactgtctgatggcgcgagggaggcgatacg

SEQ ID NO: 790851 - DNA, 736 bp, Homo sapiens
  misc_feature: 19485.44.33.C11.1.pb.heavy.1.raw 19485
cgtatcgcctccctcgcgccatcagacagtatatacacgaccggtgctcgatttagagtgagctcgttgggtttggggctggagaggagcccagcaccagaagtcggcggtgtttccagtcgggtgatcagccaccgaacacagaggactcaccatggagtttgggctgacctgggttttcctcgttgctctttaagaggtgtccagtgtcaggtgaagctggtggagtctgggggaggcgtggtccagcctgggaggtccctgagacttctcctgtgtagcgtctggattcaccttcaacagacatggcatgcactgggtccgccaggctccaggcaagggactggagtgggtggcacttatatggtatgatggaagtaataaatattatgtagagttccgtgaaggggccgattcaccatctccagagacaattcgaagaacacactatatctggaaatgaatagcctgagagccgaggacacggctgtctactactgtgcgagagatggggctcgtggatacagatatgacatgctcttactccaaatggtatgacgcctggggccaagggaccacggtccgcgtctcctcagccctccaccaaagggcccatcggtcttccccctggcaccctcctcccaagagcacctctggggcccagcggccctgggctggccctggtcaaaggactacttcctatatactgtctgagcggggctggcaaggcgcatag

SEQ ID NO: 790852 - DNA, 689 bp, Homo sapiens
  misc_feature: 19503.44.33.C11.1.pb.heavy.1.raw 19503
cgtatcgctcctcctcgcgccatcagacagtatatacacgaccggtgctcgatttagagtgagctcgttgggtttgggctgggagaggagccagcaccagaagtcggcggtggtttccagtcggtgatcagcaccgaacacagaggactcaccatggagtttgggctgacctgggtttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggccacttatatggtatgatggaagtaataaatatatgtagattccgtgaagggccgattcaccatctccagagacaattcgaagaacacactatatctggaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttccccctggcaccctcctccaagagcactctggggcacagcggccctgggctgcctggtcaaggactacttcc

SEQ ID NO: 790853 - DNA, 709 bp, Homo sapiens
  misc_feature: 19534.44.27.C05.1.pb.heavy.1.raw 19534
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggcctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccgggcgacttccagtgctgggctcgtctcccagggctccccaaacccttcgatcgcgtctaaatcgagcaccggtcgtggtatatactgtctgatggcgcgagggaggcgatacg

SEQ ID NO: 790854 - DNA, 690 bp, Homo sapiens
  misc_feature: 19541.UNK.UNK.UNK.pb.heavy.1.raw 19541
cgtatcgcctccctcgcgccatccagtctatacatcacgaccggtgcgattttgatcacataacaaaccacactcctcctctaagagcccctggagcacagctcatcaccaattggactcggacctggcggttcctcttgtggtgggcagcagctacaggtgtccagtcccaggtgcagctggtgcaagtctgggggctgaggtgaaggagcctgggtcctcggtgaaggtctcctgcaaggcttctggaggcaccttcttcagctatgcttttatttgggtgcgacagccccctggacaagggcttgagtggctgggagggatcatccctatctttggtgcatcgaattacgcacagaagtttcaggacagagtcaccattacgcggacgaatccacgagtacagcctacatggagctgagcaggctgagatctgaagacacggccatctatttctgtgcgagagccctcgtcaactttcatagtccctctcatagtcccacacatggaaattggttcgacccctggggccagggaaccctggtcaccgtctcctcagcttccaccaagggcccatcggtcttcccctggcgcctgctcaggagccaccttctgggggcacagcggcctggctgcctggtcaaggactacttcctatatactgtctgagcgggctggcaaggcgcatag

SEQ ID NO: 790855 - DNA, 731 bp, Homo sapiens
  misc_feature: 19547.44.39.D06.1.pb.heavy.1.raw 19547
ctatgcgccttgccagccgctcagacagtatataggaagtagtccttgaccaggcagcccagggccgctgtgcccccagaggtgctcctggagcagggcgccaggggaagaccgatggccccttggtggaagctgaggagacggtgaccgacgtcccctgccccagacatccatcaaatagtagtagtttatgattccccgaaccgtttccttggaggtccccctcgcacagtaataaacagacgtgtcgtcaactctcacgctgttcattgcaaatacagcatattcttggaattgtctctggagatggtgaatcgggcccttcacggagtctgagtaatacttctcacttccatcgtcggagatgactgccacccactccggcccttgcctggagcctggcgggaccccagtgcaaaccaaatctatcgaatgagaaacccagaggctacacaggagagtctcagggacctcccggctggacacgctccccccagactccaccagtgctctcctggacactggacacctcttaaaagagcagcaacgaggaaaacccagctcagcccaaactccatggtgagtcctctgtgttcagtgatgatcaccgaatggaaacaccggcgacttccagtgctgggctcgtctctcccccaaagaactgcgagatgtcactaaatcgagcaccggtcgtgtatatactgtctgatggcgcgaggaaggccgatacg

SEQ ID NO: 790856 - DNA, 592 bp, Homo sapiens
  misc_feature: 19551.UNK.UNK.UNK.pb.heavy.1.raw 19551
ctatgccttccagcccgctcagacagtatataggaagtagtcttgaccaggcagccaggcgctgtccccagagtgctcttggaggaggtgccagggggaagaccgatggccttggtgaggctgaggaacggtgaccaggttccctgcccagtgtcaagtagttggtgacgaactgccctactctcgacagtaatacacgcgtgtcgcgcgtcacagagctcacttcaggagaactggttcttggacgtgtctactgatatggtgatcgatcttgagggacgggttgtagtaggtgccactataatagatactcccaatccactcagccccttcctggctgggatcagcccagtataatactactgctgatggagcaccagagacagtgcaggtgaggacaggttccgaaggcttcacagtcctgcgatctgcagctgcagctggacagaccatctgggacgccaccagcagagaagaaccacaggtgcttcatgtttgcacaggaggtcatgactctcagaaagcccgcgaatctacatactaaatcgagcacggtcgtgtatatactgtctgatgcgcgaggagcgatacg

SEQ ID NO: 790857 - DNA, 708 bp, Homo sapiens
  misc_feature: 19559.44.36.D03.1.pb.heavy.1.raw 19559
cgtatcgcctccctcgcgccatcagacaggtatatacacgaccggtgctcgattttagctgcgtcacgatctcctcttggggagctctgagagcggagccccagccccagaattccaggtgttttcatttggtgatcagcactgaacacagaggactcaccatggagttcgggctgagctgggttttcccctgttgttattttacaaggtgtcccagagtgaagtgcagttggtggagtccgggagaacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcacctctcaagagatgacttcaagaactcattgattctgcgaatgactaacctgaaaaccgaggacacgggcatgtattattgtgttgtgtttatatcaggaactgtccactgggccagggaaccctggtcaccgtctcctcagcctccaccaagggcccatcggtcttccccctgggcgcccctgctccaggagcacctccgagagcacagcggccctggctgcctggtcaaggactacttcctatatactgtctgagcggggctggcaaggcgcatag

SEQ ID NO: 790858 - DNA, 644 bp, Homo sapiens
  misc_feature: 19561.44.53.E09.1.pb.heavy.1.raw 19561
ctatgcgccttgccagcccgctcagacagtatataggaagtagtccttgaccaggcagcccaggccgctgtgctctcggaggtgctcctggagcagggcgccaggggaagaccgatgggcccttggtggaggctgaggatgaggagacggtgaccgtggtcccttggcccagacgtcccaagcgtagtagaattgagacgacctgccataggcggacccatgtctacaagtagtagacagccgtgtcggcgcggccacagaactcactttcagggaaaactgtgtctcgacgtgtccacggatatggtgactcgaccgttgaggacgggttgtagtaggtgttcccactataatagagactcccaatccactgcagcccctctcctggggctggcggatcagccccagtagaaattacttctgtcgatggaggcaccagagaccggtgcacgtgaggacagggtctccgaaggcttcaccagtcctggcccgactcccgcagctgcggctggagacaggacccatctggagccgccaccagcaggaggaagaaccacaggtgcttccccaaacccaaccacactctctctaaatcgagcaccggtcgtgtatatactgtctgatggcgcgagggaggcgatacg

SEQ ID NO: 790859 - DNA, 703 bp, Homo sapiens
  misc_feature: 19581.44.36.D03.1.pb.heavy.1.raw 19581
cgtatcgcctccctcgcgccatcagacagtatatacacgaccggtgctcgatttagctgcgtcacgatctctcttggagctctcagagaggtgccttagccctggattccaaggcatttccacttggtgatcagcaatgaacacagaggactcaccatggagttggggctgcgctgggtttccttgttgctattttagaaggtgtccactgtgaggtgcggctggtggagtctgggggaggcttggtacagcggggggggtcctgagactctcctgtgcagcctctggattcatcttcagtgactatgccatgaactgggtccgccaggctccaggaagggctggagtgggtttcatatgttaatattgctggagataccacctactacgcagactctgtgaagggccgattcaccaattccagggacaatgccaagaactcactgtatctggaaatgaacagcctgagagacgaggacacggctgtctacttctgttcgagagatcgggcacttggtcagtggctggttttgactactggggccgggaaccctggtcaccgtctctcagcctccaccaagggcccatcgtcttccccctggcgccctgctccaggagcacctccgagagcacagcggccctgggctgcctggtcaaggactacttcctatatactgtctgagcgggctggcaaggcgcatag

SEQ ID NO: 790860 - DNA, 722 bp, Homo sapiens
  misc_feature: 19588.UNK.UNK.UNK.pb.heavy.1.raw 19588
tctatgcgccttgccagcccgctcagacagtatcataggaaagtagtccttgaccaggcgccagcccagggccgctgtgctctcggaggtgctcctggagcagggcgcccaggggaagaccgatgggccttggtggaggctgaggagacggtgaccagggtccccctggccccagccagtcatcgcgcccggtaataactactaccaccctcccgatctcgcacagtaatacagagccgagtcctcgactctcaggctgaccatttccaagtacacaatgttccgggaattgtctctggagatggtgaatccggccttcacggagtctgcataatattcagaactccatcatgtgcctataactgccaaccactccggcccctttgcctgagctggcggacccagtgcatgccagaaccactgaaactaaatccagagcttcacaggagagtcttcaggggacctcccaggctggaccacgcctccccagactccaccaggtgcacctgacagtgggacacctcttaaaagagcaacgaggaaaacccagctcagcccaaactccatgtgagtcctctgtgttcagtgctgatcaccgaatggaaacaccccgccgacttctagtgctgggctcctctcccagacccctttcccttcacactacactaaatcgagcaccggttcgtgtatatactgtctgatggcgcgagggaggcgatacg

SEQ ID NO: 790861 - DNA, 607 bp, Homo sapiens
  misc_feature: 19591.UNK.UNK.UNK.pb.heavy.1.raw 19591
gaaggctgggcaggctatgcaccctggtccaggtcaaaagctgcggaacccgctagcggcccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttagggaagtagacaaacccattactccacttcccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaagcaatatgtcgtccttagctccaagtccctagcaagcgtgtcggg

SEQ ID NO: 790862 - DNA, 665 bp, Homo sapiens
  misc_feature: 19636.UNK.UNK.UNK.pb.heavy.1.raw 19636
cgtatcgcctcctcgcgccatcagacagtatatacacgaccggtgccgatttagtagtgtagattccgcgggggctttatgagagtcatggagcctcctgtgcaaaacatgaagcacctgtgttctcctccctgctggtggcggctccagatgggtcctgtcccagctgcagctgcaggagtcggcggggccaggactgtgaagccttcgcgagacctgtccctcacctgcactgtctctgtggctccatcagcagtagtagttactactgggggctggatcgcagccccccaggaaggggctggagtggattgggagtatctattatagttgggagcacctactacaaccgtccctcaagagtcgagtcccatatcagtagacacgtccaagaaccattctcctgaagctgagctcgtgaccgccgcggacacggcgtgtattactgtgcgagagtagggcagttcgtcaccaactacttgaccactggggcccagggaaccctggtcaccagtctcctcagcctcaccaaggggcccattcggtcttcccctggcaccctcctccaagagcacctctgggcacagcggccctggtgcctggtcaaggactacttcctatataactgtctggtagcggtgcctgttgtcagaggcgcatgacga

SEQ ID NO: 790863 - DNA, 723 bp, Homo sapiens
  misc_feature: 19638.UNK.UNK.UNK.pb.heavy.1.raw 19638
cgtatcgcctccctcgcgccatcagacagtatatacacgacgcgtgctcgatttagtatcactcagtcgcggggagctctgggagaggagcccagcactagaagtcggcggtgtttccattcggtgatcagcactgaacacagaggactcaccatggagtttgggctgagcctgggttttcctcgttgctcttttaagaggtgtccagtgtcaggtgcagctggtggagtctggggaggcgtgtccagcctgggaggtccctgagactctcctgtgcagcgtctggattcaccttcagtacctatggcatgcactgggtccgccaggcttccaggcaaggggctggagtgggtggcacttatatggtatgatggaagtaataaatactatgcagactccgtgaagggccgattcaccatctccagagacaattccaagaacacgcctgtatctgcaatgaacagcctgagagccgaggacacggctgtgtattactgtgcgaggacatattgtagtactaccacctgctgggactactactacggtatggacgtctggggccaagggaccacggtcaccgtctcctcagcctccaccaaagggcccatcggtcttccccctggcaccctcctccaagagcacctctggggcacagcggccctgggctgcctggtcaaggactacttcctatatactgtctgagcgggctggcaaggcgcatag

SEQ ID NO: 790864 - DNA, 693 bp, Homo sapiens
  misc_feature: 19671.44.36.D03.1.pb.heavy.1.raw 19671
cgtatcgcctccctcgcgccatcagacagtatatacacgaccggtgctcgatttagctgcgtcacgatctctcttgggagctctgagagcggagcccagcccagaattccaggtgttttcatttggtgatccagcactgaacacagaggatcaccatggagttcgggctgagctgggtttcttgtgttattttacaaggtgtccagagtgaagtgcagttggtggagtccgggggagacttggtccagcctggagggtccctgagactctcctgtgtcgcctctggatttcaccatccagtgaccactatatggactgggtccgccaggctccagggaagggctggagtggcttggccgcagtaaaaaacaaagttgccagctttatcacagagtacgccgcgtctgtgaaagccagattcaccctctcaagagatgacttcaagaactcattgattctgcgaatgactaactgaaaccgaggacacggcatgtattattgtgttgtgtttatatcaggaactgtccactggggccagggaaccctggtcaccgtctcctcagcctccaccaagggccatcggtcttcccctggcgccctgctccaggagcacctccgagagcacagcggccctgggctgcctggtcaaggctacttcctatatactgtctgagcggctggcaaggcgcatag

SEQ ID NO: 790865 - DNA, 679 bp, Homo sapiens
  misc_feature: 19716.UNK.UNK.UNK.pb.heavy.1.raw 19716
ctatgcgccttgccagcccgctcagacagtatataggaagttagtccttgaccaggcagcccagggccgctgtgctctcggaggtgctcctggagcagggcgccaggggaagaccgatgggcccttggtggaggctgaggagacggtgacagggttccctggcccgaatgaaaccatcccagacagtaatagacggctgtgtcctcggtgttcaggctgttcatctgcagagacaccgtatcttttgaatcatctcttgagatgggaatctgcctttcacgggtgcagcgtagtctgctgtcccaccgtcagctttggttctaatacggcaacccactccagccccttccctggagcctggcggacccaggtcatccaggcgttactgaaagtgaatccagaggctgcacaggagagtctaagggactccccaggcttaaccaacctcccccagactccaccaactgccctcacactggacaccttttaaaatagcagcaaggaaatccagctcagcccaaactccatggtgagtcctctgtgttcagtcctgatcactgaatgaaaaacacctgggaatcccaaggctggggctcctctcccagagctcaacacactctctctaaatcgagcaccgggtcgtgtatatactgtctgatggcgcgagggaggcgatacg

SEQ ID NO: 790866 - DNA, 696 bp, Homo sapiens
  misc_feature: 19722.44.71.G05.1.pb.heavy.1.raw 19722
cgtatcgcctccctcgcgccatcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgtagttttttttagaaggtgtccagtgcgaggggcgactggcggagtcgggggggcttggcacagccagggcggtctctgagactctcctgtgtagtctcaggattcagtcttagtgattatcacttggcctggggtccgtcagggctccagggaaggggcttgagtggatcactttcgtcagaatgaaacgttatggtggaagtaaagagtacgccggcgtctgtgaagggaagattcaccgtctcaagggatgactccaacagtgttggccatttacaaatgagcaacctgagacccgacgacacaggcgtctattactgcgccagcgatcctgggacgtcgatgcatttgatatttggggccagggaacaatggtcaccgtctcttcagcttccaccaaagggcccatcggtcttcccctggcgccctgctcaggagcacctctgggggcacagcggccctgggctgcctggtcaaggactacttcctatatactgtctgagcgggctggcaaggcgcatag

SEQ ID NO: 790867 - DNA, 620 bp, Homo sapiens
  misc_feature: 19733.44.38.D05.1.pb.heavy.1.raw 19733
ctatggcgccttgccagcccgctcagacagtatataggaagtagtccttgaccaggcagcccagggccgctgtgcccccagaggtgctcctggagggcagggcgccaggggaagaccgatgggcccttggtggaagctgaggagacggtgaccgtggtcccttggcccagacgtccataccgtagtagtagtatgcaactcccccgaactcccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctacctgaaggtgaatccagaggctgcacaggagagtctcagggaccccccaggctgaactaagcctccccggactccaccagctgcacctcacactggacaccttttaaaatagcaacaaggaaaaccagctatcagatactaaatcgagcaccggtcgtgtatatactgtctgatggcgcgagggaggcgatacg

SEQ ID NO: 790868 - DNA, 617 bp, Homo sapiens
  misc_feature: 19742.UNK.UNK.UNK.pb.heavy.1.raw 19742
gaaaggctgggcaggctatgcacccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggctttgcaacgccactcgtaaaactagtactttgcggttaggggaagtagacaaacccattactccacttcccggaagttcaactcattccaacacgaaataaaagtaaactcaacacccccaagcaggctatgtgggggggtgataggggtggattctattttcctatcccatccctaggatctcaattaagttacctagcgagtttaaatgtcctgtagcgatcccgtcagtcctatcgcgcgcatcaagacctggttggttgagcgtgcagtagatcatcgataagctgcgagttaggtcatcccagaccgcatctggcgcctaaacgtttcagtggtagctaaggcgtcacctcgactgtctaaaggcaatatgtcgtccttagctccaaagtcccctagcaagcgtgtcggg

SEQ ID NO: 790869 - DNA, 559 bp, Homo sapiens
  misc_feature: 19773.44.43.D10.1.pb.heavy.1.raw 19773
ctaatgcgccttgccagcccgctcagacagtatataggaagtagtccttgaccaggcagcccagggccgctgtgcccccagaaggtgctcctggagcagggcgccagggggaagaccgatggggcccttggtggaagctgaggagacggtgaccagggtttccctgggcccccaggggtcgaaccacctccccgacgagctgctatactttcgggatctcgcacagtaatacacggccgtgtcctccagatctcaggctgctcagctccatgtgagcctgtgtttatggaggtgttcctggtcatggtgactctgccctggaacttctgtgcatagcctgtgttaccactgttagggttcatccatcccatccactcaagccttgtccagtggctgtcgcacccagttgatatcataattggtgaaggtgtatccagaaagccttgcaggagaccttcactgaggccccaggcttctttcacctcagccccttactgctagtctaaatcgagcaccggtcgtgatagtatagactgatggcgcgaggaggcgatacgat

SEQ ID NO: 790870 - DNA, 592 bp, Homo sapiens
  misc_feature: 19780.44.78.H01.1.pb.heavy.1.raw 19780
cgtatcgcctccctcgcgccatcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctgcttgacttgtggggccagggaaccctggtcaccgtctcctcagcctccaccaagggcccatcgtcttccccctggcgccctgctccaggagcacctccgagagcacagcgggccctgggctgcctggtcaaggactacttcctataatactgtctgagcgggctggcaaggcgcatag

SEQ ID NO: 790871 - DNA, 693 bp, Homo sapiens
  misc_feature: 19805.44.73.G07.1.pb.heavy.1.raw 19805
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggccccagtagtcaagcggggaccgtctcgaggggctctcgcacaataatagacagccgtgtcctcacttgtgaggttgtacatttgcagatgcagtgtgttcctggaattgtctctggagacggtgaatcggccccttctcggagtcctccgtagtgttcttcaattccatcttctgatataattgccacccactccagccccttgcctggagcctggcggacccagtgcatgggcataggtcctgaagatgaatccagaggctgcacaggagagtctcagggagttcccaggctggccgctcctcccccagactccactagctgcacctgacactggccacctcttaaaagagcacgaggaaaacccatctcagccaaaagtccatggtgagtcctctgtgttcagtgatgatcaccgaatggaaacaccggcgacttccagtgctgggctcgtctccccccctgagcgtagagctaaatcgagcaccggtcgtgatatactgtctgatggcgccgaagggaggcgatacg

SEQ ID NO: 790872 - DNA, 716 bp, Homo sapiens
  misc_feature: 19807.44.27.C05.1.pb.heavy.1.raw 19807
cgttatcgcctcctcgcgccatcagacagtatatacacgaccggtgctcgatttagacgcgatcgaagggtttgggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggcgccccagtaggggggtccctgagactctcctgtgcagcctctggattcaccttcgatattggaatatgcagtgggtccgccaggcctcccaggcgaggggctggagtgggtggcaggtgtgtcatttcatggaggaaatcaagtctacggtgattccgttgagggccgattcaccatctccagagacaattccggagaacacagtgtctcttcaatgaacagccctgagacctcaggacacgggccgtgtatttttgtgcgagactatctgttttccaaaatcggttcattcgacgcctggggccaggggaccctggtcaccgtctcctcggcctccaccaagggccccatcggtcttcccccctggcgccctgctccaggagcacctccgagagcacagcggccctgggctggcctggtcaaggactacttcctaatatactgtctgagcgggctggcaaggcgcatag

SEQ ID NO: 790873 - DNA, 702 bp, Homo sapiens
  misc_feature: 19810.44.27.C05.1.pb.heavy.1.raw 19810
ctatgcgccttgccagcccgctcagacagtatataggaagtagtccttgaccagggcagcccaggccgctgtgctctcgaggtgctcctggagcaggggcgccaggggggaagaccgatggcccttggtggaggccgaggagacggtgacagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccaggccctcgcctggagcctggcggacccactgcatattccattatcgaaggtgaatccagaggctgcacaggagagtctcaggacccccctactggggccacgcctcccccagactccacgaattgcacctgacacatgacacctcttaaagggcaacgaggaaaacccagctcagccaaactccatggtgagtcctctgtgttcagtgatgatcaccgagtggaaacaccggcgacttccagtgctgggctcgtctcccaggcccccaaaccctttcgatcgcgtctaaatcgagcaccggtcgtgtatatactgtctgatggcgcgagggaggcgatacg

SEQ ID NO: 790874 - DNA, 728 bp, Homo sapiens
  misc_feature: 19819.UNK.UNK.UNK.pb.heavy.1.raw 19819
ctatgcgccttgccgcccgctcagacaggtatataggaagtagtccttgaccaggcagcccagggccgcgctgtgcccccagaggtgctcttggaggagggtgccagggggaagaccgatgggcccttggtggaggctgaggagacggcgaccgtggtcccttggcccaggcgtccattaccattggagtagagcatgtcatatctgtatccacgagccccatctctcgcacagtagtagacagcgtcgtcctcggctctcaggctattcatttcagatatagtgtgttcttcgaattgtctctggagatggtgaatcgggcccttcacggaatctacataatatttattacttccatcataccatataagtgccacccactccagtccttgctggagcctggcggacccagtggcatgccatgtctgttgaaggtgaatccagacgctacacaggagagtctcaggacctccccaggctggaccacgcgcctcccccagactccaccagcttcacctgacactggacacctcttaaaagagcaacgaggaaaacccaggtcagccaaactccatggtgagtcctctgtgttcggtgctgatcaccgactggaaacacgccggacttctgtgctgggctcctctcccagccccaaacccaacgagctcactctaaatcgagcaccggcggtgtatatactgtctgatggcgcgagggacggcgatacg

SEQ ID NO: 790875 - DNA, 686 bp, Homo sapiens
  misc_feature: 19853.44.36.D03.1.pb.heavy.1.raw 19853
ctatgcgccttgccagccgctcagacagtatataggaagtagtccttgaccaggcagcccagggccgctgtgctctcggaggtgctcctggagcagggcgccaggggaagaccgatgggccttggtggaggctgaggagacggtgaccagggttccctggcccagtggacagttcctgatataaacacaacacaataatacatgccgtgtcctcggttttcaggttagtcattcgcagaatcaatgagttcttgaagtcatctcttgagagggtgaatctggctttcacagacgcggcgtactctgtgataaagctggcaacttgtttttactgcggcaagccactccagccccttccctggagcctgcggacccagtccatatagtggtcactgatggtgaatccagaggcgacacaggagagtctcagggaccctccaggctggaccaagtctcccggactccaccaactgcacttcactctggacaccttgtaaaataacaacaaggaaaacccagctcagccgaactccatggtgagtcctctgtgttcagtgctgatcaccaaatgaaaacacctgggaattctggggctggggctccgctctccccaagagagatcgtgacgcagctaatcgagcaccggtcgtgtatatactgtctgatggcgcgagggaggcgatacg

SEQ ID NO: 790876 - DNA, 714 bp, Homo sapiens
  misc_feature: 19883.44.55.E11.1.pb.heavy.1.raw 19883
cgtatcgcctccctcgcgccatcagacagtatatacacgaccggtgctcgatttagcactcgcacgttgggttttgggggggagaggagcccagcactggattccgaggtgttttccattcggtgatcagcactgaaacacagaggactcaccatggagttttggcttgagctgggttctccttgttggactttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgaatttcacatactacgcaagactccgtgaagggccgattcaccatctccagggacaatttccaaggaacacggttttatcttcaaatgaacaacctgagaggcgacgacacggccgtctaattactgtgcgagacaagtcggcgctcgagtggttattattcgtttgacttctggggccagggaacctggtcaccgtcgcctccgccctccaccaagggccatcggttcttcccctggcaccctcctccaaagagccacctctggggcacagcggccctggctgcctggtcaaggactacttcctatatactgtctgagcgggctggcaaggcgcatag

SEQ ID NO: 790877 - DNA, 701 bp, Homo sapiens
  misc_feature: 19889.UNK.UNK.UNK.pb.heavy.1.raw 19889
cgtatcgcctccctcgcgccatcagacagtatataacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggagacttagtccagcctggggggtcccagagactctcctgtgcagcctctgggctcaccgtcagcagcaactacatgagttgggtccgccaggctccagggaagggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcgagtggttattattcgtttgacttctggggccagggaaccctggtcaccgtcgcctccgcctccaccaagggcccatcggtcttccccctggcacctcctccaagagcacctctggggggcacagcggcccctgggctgcctggtcaaggactacttcctatatactgtctgagcgggctggcaaggcgcatag

SEQ ID NO: 790878 - DNA, 714 bp, Homo sapiens
  misc_feature: 19894.44.56.F01.1.pb.heavy.1.raw 19894
ctatgcgccttgccagcccgctcagacagtatataggaagtagtccttgaccaggcagcccagggccgctgtgcccccagaggtgctcctggagcagggcgccagggggaagaccgatgggcccttggtggaaagctgaagagacggtgaccattgtcccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagccccccccgactccgccagtcgcccctcgcactggacaccttctaaaaaaaactacaaggaaaatcaagattagcccaaactccatggttggtggtctgtgctcagtgctgatcaccaagtggaaactcctggaatctcacggctggggctcctctcccagagctcccctttgtgtgttcagacgtctgctaaatcgagcaccggtcgtgtatatactgtctgatggcgcgagggaggcgatacg

SEQ ID NO: 790879 - DNA, 680 bp, Homo sapiens
  misc_feature: 19899.UNK.UNK.UNK.pb.heavy.1.raw 19899
cgtatcgcctccctcgcgccatcagacagtatatacacgaccggtgctcgattttgatcacatacaccacactcctcctctaagaagccctgggagcacagctcatcaccatggactggcctggcggtcctctttgtggtggcagcagctacaggtgtccagtcccagtgcaggctggtgcagtctggggctgagggaagaagcctggggtcctcggtgaagggtctcctgcaaggcttctggaggcaccttcttcagctatgcttttatttgggtgcgacaggcccctggacaagggcttgagtggctggaggatcatcctatctttggtgcatcgaattacgcacagaagttcaggacagagtcaccattaccgcggacgaatccacgagtacagcctacatggagctgagcaggctgagatctgaagacacggccatctatttctgtgcgagagccctcgtcaactttcatagtccctctcatagtcccacacatggaattggttcgacccctgggccagggaacctggtcaccgtctcctcagcttccaccaagggcccatcggtcttcccctggcgccctgctccaggagcacctctggggggcacagcggcctgggctgcctggtcaaggactacttcctatatactgtctgagcgggctggcaaggcgcatag

SEQ ID NO: 790880 - DNA, 711 bp, Homo sapiens
  misc_feature: 19901.44.55.E11.1.pb.heavy.1.raw 19901
ctatgcgccttgccagcccgctcagacagtatataggaagtagtccttgaccagcagcccagggccgctgtgcccccagaggtgctcttggaggagggtgccagggggaagaccgatgggcccttggtggaggcggaggcgacggtgaccagggttccctggccccaggaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcaccctcacactggacaccttttaaaagtccaacaagggagaacccagcctcagccaaaactccatggtgagtcctctgtgttcagtgctgatcaccgaatggaaacacctcggaatcccagtgctgggcctcctctcaccccccaaacccaacgtgcgagtgctaaatcgagcaccggtcgtgtatatactgtctgatggcggcgaggaggcgatacg

SEQ ID NO: 790881 - DNA, 685 bp, Homo sapiens
  misc_feature: 19905.UNK.UNK.UNK.pb.heavy.1.raw 19905
cgtatcgccttccctccgcgccatcagacagtatatacacgacccggtgctcgatttagagagaggtgtgttgagctctgggagaggagcccccagccttgggatcccaggtgttttcattcagtgatcaggactgaacacagaggactccaccatgggtttggcctgagctggattttccttgctgctattttaaaaggtgtccagtgtgaggtgcagttggtggagtctgggggagggtttggtaaagcctgggatcccttagacctctgtgcagctctggattcaccttcagtaacgccctggatgacctgggtccgccaggctcccaggaaggggctggagtgggttggccgtattagaaccaaagctgacggtgggacagcgaactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatcggtcttccccctggcgccctgctccaggagcacctccgagagcacagcggccctgggcctgcctggtcaaggactacttcctatatactgtctgagcgggctggcaaggcgcatag

SEQ ID NO: 790882 - DNA, 703 bp, Homo sapiens
  misc_feature: 19912.44.73.G07.1.pb.heavy.1.raw 19912
ctatgcgccttgccagcccgctcagacagtatataggaagtagtccttgaccaggcagcccaggccgctgtgctctcggaggtgctcctgagcagggcgccaagggggaagaccgatgggcccttggtggaggctgaggagacggtgaccagtgtcccctggccccagtgaaacgcccgataatagctgctgccacttcccgatctcgcacagtaatacagagccgagtcctcgcctctcaggctgatcatttccaggtacagagtgttccgggaattgtctctggagatggtgaatcggcccttcacggagtctgcataatatctagaagttccatcatatgctataactgccaaccactccggccccttgcctggagcctggcggacccagtgcatgccagaactactgaaactaaatccagaggcttcacaggagagtctcagggacctcccaggctggaccacgcctcccccagactccaccaggtgcacctgacactggacacctcttaaaagagtaacgaggaaaacccagctcagcccaaactccatggtgagtcctctgtgttcagtgctgatcaccgaatggaaacaccgccgacttctagtgctgggctcctctcccagagctcccctgagcgtagagctaaatcgagcaccggtcgtgtatatactgtctgatggcgcgaggaggcgatacg

SEQ ID NO: 790883 - DNA, 711 bp, Homo sapiens
  misc_feature: 19918.44.55.E11.1.pb.heavy.1.raw 19918
ctatgcgccttgccagcccgctcagacagtatataggaagtagtccttgaccaggcagcccagggccgctgttgcccccagaggtgctcttggaggagggtgccagggggaagaccgatgggcccttggtggaggcggaggcgacggtgaccagggttccctggccccagaagtcaaacgaaataataaccactccgagcgccgacttgtctcgcacagtaatagacggccgtgtcgtcgcctctcaggttgttcattttgaagaataacccgtgttcctggaattgtccctggagatggtgaatcggcccttcaacggagtctgcgtagtatgtgaaatcaccagtataaatgactgagacccactccagccccttcctgggcctggcggacccaactcatgtagttgctgctgacggtgagccagaggctgcacagagagtctctgggacccccaggctggactaagcctcctccagactccatcagccgcacctcacactggacacctttaaaagtccaacaaggagaacccagctcagccaaaactccatggtgagtcctctgtgtttcaagtggctgatcaccgaatggaaaacaccttcggaatcccagtgctgggctcctctcccccccaaacccaacgtgcgagtgctaaaatcgagcaccggtcgtgtatatactgtctgatggcgcgagggaggcgatacg

SEQ ID NO: 790884 - DNA, 702 bp, Homo sapiens
  misc_feature: 19919.44.36.D03.1.pb.heavy.1.raw 19919
cgtatcgcctccctcgcgccatcagacagtatatacacgaccggtgctcgatttagctgcgtcacgatctctcttggggaggctctgagagcggagccccagccccagaattcccaggtgttttcatttggtgatcagcactgaacacagaggactcaccatggagttcgggctgagctggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaagggctggagtggcttggccgcagtaaaaacaaagtgccagctttatcacagagtacgccgcgtctgtgaaagccagattcaccctctcaagagatgacttcaagaactcattgattctgcgaatgactacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790885 - DNA, 648 bp, Homo sapiens
  misc_feature: 19924.44.23.C01.1.pb.heavy.1.raw 19924
ctatgcgccttgccagcccgctcagacagtatataggaagtagtccttgaacaggcagcccagggccgctgtgccccagaggtgctcctggagcagggcgccaggggaagaccgatgggcccttggtggaagctgaggagacagtgaccagggtgccacggccccatagattgaaagacagtctcgcctcgcacagaaataaacggccgtgtccgcggcggtcacggaggtcagtttcaggagaagcggttcatggacgtgtccctcgaaatggtgagacgactcttgagggacggagagtagtacgtcgcccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcccccaatccctaatcacgtgtactaaatcgagcaccggtcgtgtatatactgtctgatggcgcgagggaggcgatacg

SEQ ID NO: 790886 - DNA, 718 bp, Homo sapiens
  misc_feature: 19955.UNK.UNK.UNK.pb.heavy.1.raw 19955
ctatgcgccttgccagcccgctcagacagtatataggaagtagtccttgaccaggcagcccagggccgctgtgcccccagaggtgctcctggagcagggcgccaggggaagaccgatgggcccttggtggaagctgaagagacggtgaccattgtcccctggccccaaatatcaaatgcatcgacgtcccaggatcgcctggcgcagtaatagacgcctgtgtcgtcgggtctcaggttgctcatttgtaaaatggccaacactgttggagtcatcccttgagacggtgaatcttcccttcacagacgcggcgtactctttacttccaccataacgttttcattctgacgaaagtgatccactcaagccccttccctggagcctgacggacccaggccaagtgataatcactaagactgaatcctgagactacacaggagagtctcagagaccgccctggctgtgccaagccccccccgactccgccagtcgccctcgcactggacacctctaaaaaaactacaaggaaaaatcaagattagcccaaactccatggttggtggtctgtgctcagtgctgaatcaccaagtggaaactcctggggaatctcacggctggggctcctctccagagctcccctttgtgtgttcagacgtctgctaaatcgagccaccggtcgtgtatatactgtctgatggcgcgagggggaggcgatacg

SEQ ID NO: 790887 - DNA, 706 bp, Homo sapiens
  misc_feature: 19962.44.36.D03.1.pb.heavy.1.raw 19962
ctatggccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataaatacatgcccgtgtcctcgggttttcagggttagtcattcgcagaatcaatgagttcttgaagtcatctcttgagagggtgaatctggctttcacagacgcggcgtactctgtgataaagctggcaactttgttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 790888 - DNA, 689 bp, Homo sapiens
  misc_feature: 19975.44.73.G07.1.pb.heavy.1.raw 19975
ctatgcgccttgccagcccgctcagacagtatataggaagtagtccttgaccaggcagcccagggccgctgtgctctcggaggtgctcctggagcagggcggccaggggaagaccgatggcccttggtggaggctgaggagacggtgaccaggggttccctggccccagtagtcaagcggggaccgtctcgaggggctctcgccacaataatagacagccgtgtcctcacttgtgaggttgtacatttgcagatgcagtgtgttcctggaattgtctctggagacggtgaatcggcccttctcggagtctccgtagtgttcttcaattccatcttctgatataattgccacccactccagccccttgcctggagcctggcggacccagtgcatggcataggtcctgagatgaatccagaggctgcacaggagagtctcagggagttcccaggctgggccgctcctcccccagactccactagctgcacctgacactggccacctcttaaagagcaacgaggaaaacccatctcagcccaaagtccatgtgagtcctctgtgttcagtgatgatcacgaatggaaacaccggcgacttccagtgctgggctcgtctccccccctgagcgtagagctaaatcgagcaccggtcgtgtatatactgtctgatggcgcgagggaggcgatacg

SEQ ID NO: 790889 - DNA, 718 bp, Homo sapiens
  misc_feature: 20050.44.55.E11.1.pb.heavy.1.raw 20050
cgtatcgcctcctccgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgccggctgatggagtctggaggaggcttagtccagcctggggggtcccagagactctcctgtgggcagcctctgggctcaccgtcagcagcaactacatgagtggccgtcggccaggctccagggaagggcctggagtggtctcagtcatttatactggtgatttcaccatactacgggcagacttccgtgaagggccgattcaccatctccagggacaattccaggaacagcgtttatcttcaaatgaacaacctgagaggcgacgacacggccgcgtctattactgtgcgagacaagtcggcgctccggaggtggttattattcgtttgacttctggggccagggaaccctggtcaccgtcgcctccgctccaccaaggggcccatcggtcttccccctggcaccctcctccaagagcacctctgggggcacagcggccctgggctgcctggtcaaggactacttcctgatatactgtctgagcgggctggcaaggcgcatag

SEQ ID NO: 790890 - DNA, 633 bp, Homo sapiens
  misc_feature: 20074.44.23.C01.1.pb.heavy.1.raw 20074
cgtatcgcctccctcgcgccatcagaccagtatatacacgaccggtgctcgatttagtacacgtgattagggattggggccagggtgaacaccctgtggtttttcctcctgctggtgggcagctcccagatgggtcctgttcccaggtgcagctgccaggagtcggggcccaggactggtgaggccttcggggaaccctgtctctcatctgcactgtctctggagtttccatcagttctgatcattcctggggctggatccgcggcagccccagggagggaatggagtggattggtgacatccattatactggggcgacgtactactctcgcgtccctcaagagtcgtctcaccatttcgagggacacgtccatgaaccgcttctccctgaaactgacctccgtgaccgccgcggacacggccgtttatttctgtgcgaggcggactggtctttcaatctatggggccgtggcaccctggtcactgtctcctccagcttccaccaaggggccccatcggtcttcccccctggcggccctgctccaggagcacctctgggggccacagcggccctgggctgcctggtcaaggactcttcctatatactgtctgagcgggctgcaaggcgcatag

SEQ ID NO: 790891 - DNA, 627 bp, Homo sapiens
  misc_feature: 20095.44.38.D05.1.pb.heavy.1.raw 20095
cgtatcgcctccctcgcgccatcagacagtatatacacgaccggtgctcgatttagtatctgatagctgggttttccttggttgctattttaaaaggtgtccagtgtgaggtgcagctggtggagtccgggggaggcttagttcagcctggggggtccctgagactctcctgtgcagcctctggattcacctttcagtagcttactggatgcactgggtccgccaagctccagggaaggggctggtgtgggtctcacgtattaatagtgatgggagtagcacaagctacgcgggactccgtgaagggccgattcaccatctccagagacaacgccaagaacacgctgtatctgccaaatgaacagtctgagagccgaggacacggctgtgtattactgtgcaagagccggtgcgggagttcggggagttgcatactactactacggtatggacgtcttggggccaagggaccacggtccaccggtctcctcagcttccaccagggcccatcggtcttccccctggcgccctgctccaggagcacctctgggggcacagcggccctgggctgcctggtcaaggactacttcctatatactgtctgagcgggctgggcaaggcgcatag

SEQ ID NO: 790892 - DNA, 601 bp, Homo sapiens
  misc_feature: 20096.UNK.UNK.UNK.pb.heavy.1.raw 20096
gaaggctgggcaggctatgcaccctggtccaggtcaaaagctgcggaacccgctagcggccatcttggccactaggggtcccgcagattcataattgtcgtctagcatgcacaatgctggcaacccagcttgcaatgcccacagcaagcggccaatctttacgccacgttgaattgtttatacctgtgactgggctatggcttgcacgcactcgtaaaactagtactttgcggttagggaagtagacaaacccattactcagcttcccgaagttcaactcattccaacacgaaataaagtaaactcaacaccccaagcaggcatgtggggggggtgataggggtggattctattcctatccattcccctaggatctcaattaagttactagcgagttaaatgtctgtagcgatccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccagtccctagcaagcgtgtcggg

SEQ ID NO: 790893 - DNA, 698 bp, Homo sapiens
  misc_feature: 20116.44.55.E11.1.pb.heavy.1.raw 20116
ctatgcgccttgccaggccgcctcagacagtatataggaagtagtccttgaccaggcagccaggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtcctggagatggtgaatcggcccttcacggagtctgcgtagtatgtgaaatcaccagtataaatgactgagaccccactccagccccttccctggagcctggcggacccaactcatgtagttgctgctgacggtgagcccagaggctgcacaggagagtctctgggacccccaggctggactaagcctcctccagactccatcagcccgcacctcacactggacaccttttaaaagtccaacaaggagaacccagctcagccaaaactccatggtgagtcctctgtgttcagtgctgatcaccgaatggaaacactcggaatcccagtgctgggctcctctcccaaaccaacgtgcgagtgctaaatcgagcaccggtcgtgtatatactgtctgatggcgcgaggaggcgatacg

SEQ ID NO: 790894 - DNA, 712 bp, Homo sapiens
  misc_feature: 20125.UNK.UNK.UNK.pb.heavy.1.raw 20125
ctatgcgccttgccagcccgctcagacagtatataggaagtagtccttgaccaggcagcccagggccgctgtgcccccagaggtgctcctggagcagggcgccagggggaagaccgatgggcccttggtggaagctgaagagacggtgaccattgtcccctggcccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcgcgtactctttacttccaccataacgtttcattctgacgaaagtgatccactcaagccccttccctggagcctgacggaccaaggccaagtgataatcactaagactgaatcctgagactacacaggagagtctcagagaccgccctggctgtgccaagcccccccccgactccgccagtcgcccctcgcactggacaccttctaaaaaaactacaaggaaaatcaagattagcccaaactccatggttggtggtctgtgctcagtgctgatcaccaagtggaaaactcctgggaatctcacggctggggctcctctcccagcccctttgtgtgttcagacgtctggctaaaatcgagcaccggtcgtgtatatactgtctgatggcgcgagggaggcgatacg

SEQ ID NO: 790895 - DNA, 705 bp, Homo sapiens
  misc_feature: 20143.44.36.D03.1.pb.heavy.1.raw 20143
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790896 - DNA, 649 bp, Homo sapiens
  misc_feature: 20175.UNK.UNK.UNK.pb.heavy.1.raw 20175
ctatgcgccttgccagcccgctcagacagtaataggaagtagtccttgaccaggcagcccagggccgctgtgctctcggagggtgctcctggagcagggcgcaggggggaagaccgatgggcccttggtggaggctgatgagacggtgacctggattccctggccccagggttcgaagaagcccggtggtcattgtggtcatgaagtgggcacagaatatgtgcctgtgtcacagggtccacgttggtcaatgtaaggaccacctggttttggacgtgtccttcgtgagcgtgaggtctggtcgtcagagaaggactatatcgtatatcgtcattccaataagtgagtgcgatccactccagggcctttccggggggctgccgcacccagacaacgccctctccaggagtgacgagtgagaagcctgagacggtgcaggtcagcgtgagggtctgtgtggtttcaccaatgtagggcagactcttcacggtgatctggaccggccccccatgaagggatggtcagcagcaggagcgtggagcaaagtgtgtccatggtgggcacaggagtcccccttttcccttcacactacactaaatcgagcacgggtcgtgtatatactgtctgatggcgcgagggaggcgatacg

SEQ ID NO: 790897 - DNA, 662 bp, Homo sapiens
  misc_feature: 20182.UNK.UNK.UNK.pb.heavy.1.raw 20182
cgtatcgctccctctcgcgccatcagacagtatataccacgaccggtgctcgattagtacatgattgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcggggaaccctgtctctcatctgcactgtctctggagtttccatcagttctgatcattcttggggctggatccggcagcccccagggaggggaatggagtggattggtgacatccattatactggggcgacgtactactctcccgtccctcaagagtcgtctcaccatttcgaggggacacgtccatgaaccgccttctccctgaaacctgacctcccgtgaccggccgcggacacggccgtttatttctgtgcgaggcgagactggtctttcaatctatggggccgtggcaccctggtcactgtctcctcagcttccaccaaggggcccatcggtcttccccctggcgccctgctccaggagcacctctggggggcacagcggccctgggctgcctggtcaaggactacttcctatatactgtctgagcgggctggcaaggcgcatag

SEQ ID NO: 790898 - DNA, 726 bp, Homo sapiens
  misc_feature: 20193.44.55.E11.1.pb.heavy.1.raw 20193
ctatgccgccttgccagcccgctcagacagtatataggaagtagtccttgaccaggcagcccagggccgctgtgcccccagaggtgctcttggaggaggggtgccagggggaagaccgatgggcccttggtggaggcggaggcgacggtgaccagggttcccctggccccagaagtcaaacgaataataaccacctccgccgcgccgacttgtctcgcacagtaatagacgggccgtggtcgtcgctccttcaggttgttcatttgaaagataaaccgtggttcctgggaatttgtccctggagatggtgaatcggccctatcacggagtctgcgtagtaatgtggaaatcaccagtaataaatgactgagacccactccacgccctttccctggagcctggcggacccaactccatgtagtttgctgctgacgtgagcccagaggctgcacaggagagtctctgggacccccccaggctggactaagcctcctccagactccatcagccgcacctcacactggacaccttttaaaagtccaacaaggagaacccagctcagccaaaactccatgggtgagtcctctgtgttcagtgctgatcaccgaatggaaacacctcggaatcccagtgctgggctcctctccccaaaccccaacgtgcgagtgctaaatcgagcaccggtcgtgtatatactgtcctgatgggcgcgagggaggcgatacg

SEQ ID NO: 790899 - DNA, 696 bp, Homo sapiens
  misc_feature: 20235.44.21.B10.1.pb.heavy.1.raw 20235
cgtatcgcctccctcgcgccatcagacagtatatacacgaccggtgctcgatttagtgtcgtcgcaaaagagagaggagccccagccgtgagattccaggagtttccacttggtgatcagcactgagcacagaaccaccaaccatggagtttgggctatcttgattttccttgtagtttttttagaaggtgtccagtgcgaggggcgactggcggagtcggggggggcttggcacagccagggcggttctctgagactctcctgtgtagtctcaggattcagtctagtgattatcacttgggcctgggtccgtcaggctccagggaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctggacccgacgacacaggcgtctattactgcgccaggcgatcctgggacgtcgatgcatttgatatttggggccagggacaatggtcaccgtctcttcagctttcaccaagggcccatcggtcttccccctggcgccctgctccaggagcacctctgggggcacagcggccctgggctgcctggtcaaggactacttcctatatactgtctgagcgggctggcaaaggcgcatag

SEQ ID NO: 790900 - DNA, 648 bp, Homo sapiens
  misc_feature: 20272.UNK.UNK.UNK.pb.heavy.1.raw 20272
ctatgcgccttgccagccgcctcagacagtatataggaagtagtcttgaccaggcagccaggccgctgtgcccccagaggtgccttgaggagggtgccaggggaagaacgatggccccttggtggaggctgagagacggtgacagggttccctggccccagtggtcaaagtagttggtgacggactgccctactctcgcacagtaatacacgccgtgtcgcggcggtcacagagctcagcttcagggagaactggttcttggagtgtctactgatatggtgactcgactcttgagggacgggttgtagtaggtgctcccactataatagatactcccatccactccagcccttccctggggcttgcggatcagccccagtagtaactactactgctgatggagccaccagagacagtgcaggtgagggacagggtctccgaaggcttcaccagtcctgggcccgactcctgcagctgcagctggacaggacccatctgggagccgccacagcaggaggaagaaccacaggtgcttcatgttcttgcacaggaggtccatgactctcaggaaagccccgcggaatctacactactaaatcgagcaccgtcgtgtatatactgtctgatggcgcgagggaggcgataccg

SEQ ID NO: 790901 - DNA, 546 bp, Homo sapiens
  misc_feature: 20281.44.43.D10.1.pb.heavy.1.raw 20281
cgtatcgcctccctcgcgccatcagacagtatatacacgaccggtgctcgatttagactagcagtaagggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcggggaggtggttcgaccctggggccagggaaccctggtcaccgtctcctcagcttccccaagggcccatcggtcttccccctggcgcctgctccaggagcacctctgggggcacagcggccctgggctgcctggtcaaggactacttcctatatactgtctgagcgggctggcaaggcgcatag

SEQ ID NO: 790902 - DNA, 658 bp, Homo sapiens
  misc_feature: 20286.UNK.UNK.UNK.pb.heavy.1.raw 20286
cgtatcgcctccctcgcgccatcagaccagtatatacacgaccggtgcctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacgggtctctggtgcctccatcgacagaagtaatttctactggggctggatccgccagcccccaggagaggggctgcagtggattgggagtctctattatagtgggaacacctactacaacccgtccctcaacggtcgagtcaccatatccgtggacgcgtcgaggacacagttttccctgaagtgagttctgtggccgccgccgacacggctgtcttactactgtgtcagacatgggtccgcctatggcagtcgtctcaattctactacgcttgggacgtctggggccaagggaccacggtcaccgtctcctcatcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790903 - DNA, 701 bp, Homo sapiens
  misc_feature: 20333.UNK.UNK.UNK.pb.heavy.1.raw 20333
cgtatcggcctccctcgcgccatcagacagtatatacacgaccgggtgctcgatttagacgcgatcgaagggtttgggggaagaggaagttcgccggtgtttccactcggtgatcatcactggaacacagaggactcaccatggagtttgggctgagctgggttttcctcgttgccctcttaagaggtgtcatgtgtcaggtgcaattcgtggagtctgggggaggcgtggccccagtagggggggtccctgagactctcctgtgcagcctctggattcaccttcgataattggaatatgcagtgggttccgccaggctccaggcgaggggctggagtgggtggcaggtgtgtcgatttcatggaggaaaatcaagtctacggtgattccgttgaggggccgattcaccatctccagagacaatttccgagaacacagtgtctcttcaaatgaacagcctgagacctcaggacacggccgtgtatttttgtgcgagactatctgttttccaaaatcggttcattcgacgcctgggggccaggggaaccctggtcaccgtctcctcggcctccaccaagggcccatcggtcttccccctggcgccctgctccaggagcacctccgagagcacagcggcctgggctgccttggtcaaggactacttcctatatactgtctgagcgggctggcaaggcgcatag

SEQ ID NO: 790904 - DNA, 684 bp, Homo sapiens
  misc_feature: 20370.UNK.UNK.UNK.pb.heavy.1.raw 20370
cgtatcgcctccctcgcgccatcagacagtatatacacggaccggtgctcgatttagcacacgatagttgggtttggggatactttctgagactcatgggcctcctgcacagaacatgaaacacctggtggttcttcctcctcctggtggcacctcccagatgggtcgtgtccgaggtgcagctgcaggagtcgggccccaggacgggtgaagccttcggagaccctgtccctcacctgcaatgtctctggtggttacatcagtagttattattggagttggctgccggcagtccgccgggaagggactggaggtggattgggcgcatctataacagtggcagcaccaactacaaccccgccctcaagagtcgagtcaccatgtcactagacaggtccaagaaccagttctcctgaaattgacttctgtgaccgccgcggacacggccgtatattattgtgcgagagattcctatcgatacagtagagacgggggggcgaactggctcgacccctggggccagggaaccctggtcaccgtctcctcagcctccaccaagggccccatcgggtcttccccctggcaccctcctccaagagcacctctgggggcacagcggccctgggctgcctggtcaaggactacttcctatatactgtctgagcgggctggcaaggcgcatag

SEQ ID NO: 790905 - DNA, 692 bp, Homo sapiens
  misc_feature: 20375.44.73.G07.1.pb.heavy.1.raw 20375
cgtatcgcctccctcgcgccatcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggaggagcggcccagcctgggaactcctgagactctcctgtgcagcctctggattcatcttcaggacctatgccatgcactgggtccgccaggctccaggcaaggggctggagtgggtggcaattatatcagaagatggaattgaagaacactacggagactccgagaagggccgattcaccgtctccagagacaattccaggaacacactgcatctgcaaatgtacaacctcacaagtgaggacacggctgtctattattgtgcgagagccccctcgagacggtccccgcttgactactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790906 - DNA, 726 bp, Homo sapiens
  misc_feature: 20377.44.33.C11.1.pb.heavy.1.raw 20377
cgtatcgcctccctcgcgccatcagacagtatatacacgaccggtgctcgatttagagtgagctcgttgggtttggggagctctgggagaggagcccagcacccagaagtcggcggtgtttccagtcggtgatcagcaccgaacacagaggactcaccatggagtttgggctgacctgggttttctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaaggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttcccctggcaccctcctcaagagcacctctgggggcacagcggccctggctgcctggtcaaggactacttcctatatactgtctgagcgggctggcaaggcgcatag

SEQ ID NO: 790907 - DNA, 704 bp, Homo sapiens
  misc_feature: 20390.44.36.D03.1.pb.heavy.1.raw 20390
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtgacagttcctgatataaacacaacacaataatacatgcccgtgtcctcggttttcaggttagtcattcgcagaatcaatgagttcttgaagtcatctcttgagagggtgaatctggctttcacagacgcggcgtactcctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacacctgtaaaataacaacaaggaaaacccagctcagcccgaactccatggtgagtcctctgtgttcagtgctgatcaccaaatgaaaacacctgggaattctggggctggggctccgctctcagagctcccaagagagatcgtgacgcagctaaatcgagcaccggtcgtgtatatactgtctgatgggcgcgagggaggcgatacg

SEQ ID NO: 790908 - DNA, 677 bp, Homo sapiens
  misc_feature: 20401.44.35.D02.1.pb.heavy.1.raw 20401
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccaggggtcgagccagttcgccccccgtctctactgtatcgataggaatctctcgcacaataatatacggccgtgtccgcggcggtcacagaagtcaatttcagggagaactggttcttggacctgtctagtgacatggtgactcgactcttgagggcggggttgtagttggtgctgccactgttatagatgcgcccaatccactccagtcccttcccggcggactgccgcagccaactccaataataactactgatgtaaccaccagagacattgcaggtgagggacagggtctccgaaggcttcacccgtcctgggcccgactcctgcagctgcacctcggacacgacccatctgggaggtgccaccaggaggaggaagaaccacaggtgtttcatgttcttgtgcaggaggccatgagtctcagaaagtatccccaaacccaactatcgtgtgctaaatcgagcaccggtcgtgtatatactgtctgatggcgcgagggaggcgatacg

SEQ ID NO: 790909 - DNA, 634 bp, Homo sapiens
  misc_feature: 20429.UNK.UNK.UNK.pb.heavy.1.raw 20429
ctatgcgccttgcagccgctcatatataggagtagtccttgaccaggcagcccaggccgctgtgccccagaggtgctcctggagcagggcgccaggggaagaccgatgggcccttggtggaagctgaggagacagtgaccaggtgccacggccccatagattgaaagaccagtctcgcctcgcacagaaaataacgcgtgtccgcggcggtcacggaggtcagtttcagggagaagcggttcatggacgtgtccctcgaaatggtgagacgactcttgagggacggagagtagtacgtcgccccagtataatggatgtcaccaatccactccattccctccctggggctgccggatccagccccaagaatgatcagaactgatggaaactccagagacagtgcagatgagagacaggtttcccgaaggcctcaccagtcctgggccgactcctgcagctgcacctgggacaggacccatctgggagctgccaccagcaggaggaaaaaccacaggtgcttcatgttcttgcacaggaggtccttgactctcagaaagcccccaatcctaatcacgtgtactaaatcgagcacggtcgtgtatatactgtctgatggcgcgagggaggcgatacg

SEQ ID NO: 790910 - DNA, 698 bp, Homo sapiens
  misc_feature: 20430.44.36.D03.1.pb.heavy.1.raw 20430
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggccccagtggacagttcctgatataaacacaacacaataatacatgccgtgtcctcggttttcaggttagtcattcgcagaatcaatgagttcttgaagtcatctcttgagagggtgaatctggctttcacagacgcgcgtactctgtgataagctggcaactttgtttttactgcggccaagccactccagcccttccctggagcctggcggacccagtccatatagtggtcactgatggtgaatccagaggcgacacaggagagtctcagggaccctccaggctgaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctgggctccgctctcagagctccccaagagagatcgtgacgcagctaaatcgagcaccggtcgtgtatatactgtctgatggcgcgagggaggcgatacg

SEQ ID NO: 790911 - DNA, 657 bp, Homo sapiens
  misc_feature: 20432.44.86.H09.1.pb.heavy.1.raw 20432
ctatgcgccttgccagcccgctcagacagtatataggaagtagtccttgaccaggcagccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcgtcacggaggtcagtttcagggagaagcgggttcatggacgtgtccctcgaaatggtgagacgactcttgagggacggagagtagtacgtcgccccagtataatggatgtcaccaatccactccattcccctccctgggggctgccggatccagccccaagaaatgatcagaactgatggaaactccagagacagtgcagatgagagacagggttcccgaaggcctcaccagtcctggcccgactcctgcagctgcacctgggacaggacccatctgggagctgccaccagcaggaggaaaaaaccacaggtgcttcatgttcttgcacaggaggtccttgactcttcagaaagcatcccaaaacccaagtctatagcactaaatcgagcaccggtcgtgtatatactgtctgatggcgcgagggagggcgatacg

SEQ ID NO: 790912 - DNA, 642 bp, Homo sapiens
  misc_feature: 20457.44.23.C01.1.pb.heavy.1.raw 20457
ctatgcgccttgccagcccgctcagacagtatataggaagtagtccttgaccaggcagccaggccgctgtgcccccagaggtgctcctggagcagggcgccaggggaagacgatgggcccttggtggaagctgaggagacagtgaccagggtgccacggccccatagattgaaagaccagtctcgcctcgcacagaaataaacggccgtgtccgcggcggtcacggaggtcagtttcaggagaagcggttcatgacgtgtcctcgaaatggtgagacgactcttgagggacggagagtagtacgtcgccccagtataatggatgtcaccaatccactccattcccctccctggggctgccggatccagcccaagaatgatcagaactgatggaaactccagagacagtgcagatgagagacagggttccgaaggcctcaccagtcctggcccgactcctgcagctgcacctgggacaggacccatctgggagctgccaccagcaggaggaaaaaccacaggtgcttcatgttcttgcacaggaggtccttgactctcagaaagcccccaatccctaatcacgtgtactaaatcgagcaccggtcgtgtatatactgtctgatggcgcgagggaggcgatacg

SEQ ID NO: 790913 - DNA, 715 bp, Homo sapiens
  misc_feature: 20461.UNK.UNK.UNK.pb.heavy.1.raw 20461
ctatgcgccttgccagcccgctcagacagtatataggaagtagtccttgaccaggcagcccagggccgctgtgcccccagaggtgctcttggaggaggggtgccaggggaagaccgatgggcccttggtggaggcggaggcgacggtgaccagggttccctggccccagaaagtcaaacgaatataaccactccgagcgccgacttgtctcgcacagtaatagacggccgtgtcgtcgcctcttcaggttgttcattgaagataaaccgtgttcctggaattgtccctggagatggtgaatcggccccttcacggagtctggcgtagtatgtgagaatcaccagtataaatgactgagacccactccagccccttccctggagcctggcggacccaactcatgtagttgccctgctgacggtgagccagaggctgccacaggagagtctctgggaccccccaggctggactaagctcctccagactccatcagccgcacctcacactggacacctttttaaaagtccaacaaggagaacccagctcagccaaaactccatggtgagctcctctgtgttcagtgctgatcaccgaatggaaacacctcgaatccccagtgctggctcctctcccccccaaaacccaacgtgccgagtggctaatcgagcaccggtcgtgttatatactgtctgatggcgcgaggggaggcgatacg

SEQ ID NO: 790914 - DNA, 692 bp, Homo sapiens
  misc_feature: 20464.44.74.G08.1.pb.heavy.1.raw 20464
ctatgcgccttgccagcccgctcagacagtatataggaagtagtccttgaccaggcagcccagggccgctgtgcccccagaggtgctcctggagcagggcgccaggggaagaccgatgggccccttgggtggaagctgaggtgacaatgaccagggttccctgccccagatctcaaaggctccatgcgagctggggtacggacctctcgcacagtagtagacgccgtgtcgtcggatttcaaagaactcattgtcatggagactgtgtctgtggacttgtccgcggtaatcgtaattctgccccggaagtctcgtgcgtaggtgagtgagccaaaaagaggatgattccacccatccacttcaagcccttgtccaggggcctgggcgcacccagttgatggtataagtagtggaactggtagtacttccagagccgtgcaggaaagggtcaccgagggaccaaggttgcggcattctagtcccagactgcaccagttgcaccagggactggacacctgttgctgctgccacacaaagaggaacctccaggtccagtccatggtgatgagctgtgctcccaggggcttctttagaggaggaatgtggttgttatgtgatgctcccctgatagagctactaaatcgagcaccggtcgtgtatatactgtctgatggcgcgagggaggcgatacg

SEQ ID NO: 790915 - DNA, 698 bp, Homo sapiens
  misc_feature: 20470.44.36.D03.1.pb.heavy.1.raw 20470
cgtatcgcctccctcgcgccatcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagctgggttttccttgttgttattttacaaggtgtccagagtgaagtgcagttggtggagtccgggggagacttggtcagcctggagggtccctgagactctcctgtgtcgcctctggattcaccatcagtggaccactatatggactgggtcgccaggctccagggaagggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgagggacacggcatgtattattgtgttgtgtttatatcaggaactgtccactgggccagggaaccctggtcaccgtctccttcagctccaccaagggccatcggtcttccccctggcgccctgctccaggagcacctccgagagcacagcggcctgggctgcctggtcaaggactacttctatatactgtctgagcgggctggcaaggcgcatag

SEQ ID NO: 790916 - DNA, 675 bp, Homo sapiens
  misc_feature: 20475.44.6.A06.1.pb.heavy.1.raw 20475
ctagcgccttgccagcccgctcagacagtatataggaagtagtccttgaccaggcagcccagggccgctgtgcccccagaggtgctcctggagcagggcgccagggggaagaccgatgggcccttggtggaagctgaggtgacaatgaccagggttccctgcccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgccccgggaagtctcgtgcgtaggtgagtgagccaaaaagagggatgattccacccatccactcaagcccttgtccagggggcctggcgcacccagttgatggtataagtagtggaactggtagtacttccagaggccgtgcaggaagggtcaccgaggaccaaggttgcggcattctagtcccagactgcaccagttgcaccagggactggacacctgttgctgctgccaccacaaagaggaacctccaggtccagtccatggtgatgagctgtgctcccaggggcttctttagaggaggaatgtggttgtcagtagatctaaatcgagcaccggtcgtgtatatactgtctgatggcgcgagggaggcgatacg

SEQ ID NO: 790917 - DNA, 665 bp, Homo sapiens
  misc_feature: 20488.44.86.H09.1.pb.heavy.1.raw 20488
ctatgcgccttgccagcccgctcagacagtatataggaagtagtccttgaccaggcagcccagggccgctgtgcccccagaggtgctcctggagcaggggcgccagggggaagaccgatgggcccttggtggaagctgaggagaccagtgaccaggggtgccacggccccatagattgaaagaccagtctcgcctcgcacagaaataaacggccgtgtccgcgcggtcacggaggtcagtttcagggagaagcggttcatggacgtgtccctcgaaatggtgagacgactccttgagggaacgggagagtagtacgtcgccccagtatataatggatgtcaccaatccactccattccccctccctgggggctgccggatccagccccaagaatgatcagaactgatggaaaactccagagacagtgcagatgagagacagggttccccgaaggcctcaccagtcctgggcccgactcctgcagctgcacctgggacaggacccatctggagctgccaccagcaggaggaaaaaccacaggtgcttcatgttcttggcacaggaggtccttgactctcagaaagcatcccccaaaccaagtctatagcactaaatcgagcaccggtcgtgtatatactgtctgatggcgcgagggaggcgatacg

SEQ ID NO: 790918 - DNA, 711 bp, Homo sapiens
  misc_feature: 20552.44.62.F07.1.pb.heavy.1.raw 20552
cgtatcgcctccctcgcgccatcagacagtatatacacgaccggtgctcgatttagtagtcgcataaagggaaagggagctctgagagaggagcccagccctgggattttcaggtgttcttcatttggtgaccaggaccgaacagagagaagtctccatggagtttgggctgagctgcctttttcttgtggctttttaaagggtgtcgtgtgtgaagtgcagttgttggagtctggggggggcctgattcggcctgggaggtccctgaccctctcctgtgcggcctctggattcacctttagtgcctatggcatgacctggggtccgccgggctccagggaggggactggagtgggtctcaagtatcggagctggtggtgtcactttctacggagactccgtgaagggccgcttcaccatttccagggacaattcgcaggacaaattgtttctccaatgaaaaacctgaagacccgaggacacaggcgtctattactgtttgaaagccaggccacggtgacccccatgacacctttagtacttgggggccgggggacagtggtgaccgtctcttcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790919 - DNA, 725 bp, Homo sapiens
  misc_feature: 20564.UNK.UNK.UNK.pb.heavy.1.raw 20564
cgttatcgcctccctcgcgccatcagacaggtatatacacgaccggtgctcgatttagtatcactcgcagtcgcggggagctctgggagaggagcccagcactagaagtcggcggtgtttccattcggtgatcagcactgaacacagaggactcaccatggagtttggctgagctgggttttcctcgttgcttctttaaagaggtgtccagtgtcaggtgcagctggtggagtctggggagggcgtggtccagcctgggaggtccctgagactctcctgtgcagcgtctggattcaccttcagtacctatggcatgcactggtccgcccaggtccaggcaaggggctggagtgggtggcacttatatgtagtgatggaagtaaaaaatactatgcagactccggggaagggccgattcaccatctccagagacaattccaagaacacgctgtatctgcaaatgaacagcctgagagccgaggacacggctgtgtattactgtgcaggacatattggtagtactaccacctgctgggactactactacggtatggacgtctggggccaagggacccacggtcaccgtctcctcagcctccaccaagggcccatcggtctttccccctggcaccctcctccaagagcacctctggggcacagcggcctggggcgcctggtcaaggactacttcctatatactgtctggcgggctgcaaggcgcatag

SEQ ID NO: 790920 - DNA, 672 bp, Homo sapiens
  misc_feature: 20589.UNK.UNK.UNK.pb.heavy.1.raw 20589
cgtatcgcctccctcgcgccatcagacagtatatacacgaccggtgctcgatttagaggagtgtgttgagctctggagaggagccccagccttgggattccaggtgttttcattcagtgatcaggactgaacacagaggactcaccatggagtttgggctgagctggattttccttgctgctatttaaaaggtgtccagtgtgaggtgcagttggtggagtctggggaggttggtaaagcctgggagtccttagactctcctgtgcagcctctggattcacttcagtaacgcctggatgacctgggtccgccaggctccagggaaggggctggagtgggttggccgtattagaccaaagctgacggtgggacagcagactacgctgcacccgtgaaaggcagattcaccatctcaagagatgattcaaaagatacggtgtctctgcagatgaacagcctgaacacgaggacacagccgtctattactgtctgggatggttttcattcgggccagggaaccctggtcaccgtctcctcagcctccaccaagggcccatcggtcttcccctggcgcctgctccaggagcacctccgagagcacagcggccctgggctgcctgtcaaggactactggtcctatatactgtctgagcgggctggcaaggcgcatag

SEQ ID NO: 790921 - DNA, 721 bp, Homo sapiens
  misc_feature: 20608.UNK.UNK.UNK.pb.heavy.1.raw 20608
cgtatcgcctccctcgcgccatcagacagtatatacacgaccggtggctcgatttagcagacgtctggaacacacaaaggggagctctgggagaggagccccagccgtgagattcccaggagtttccacttggtgatcagcactgagcacagaccaccaaccatggagtttgggctaatcttgattttccttgtagtttttttagaggtgtccagtgcgaggggcgactggcggagtcggggggggcttggcacagccagggcggtctctgagactctcctgtgtagtctcaggattcagtcttagtgattatcacttggcctgggtccgtcaggctccagggaaggggcttgagtggcatcactttcgtcagaatgaaaacgttatggtggaagtaaagagtacgccgcgtctgtgaagggaagattcaccggtctcaagggatgactccaacagtgttggccatttacaaatgagcaacctgagaccgacgacacaggcgtctattactgcgccaggcgatcctgggacgtcgatgcatttgatatttggggccaggggacaatggtcaccgtctcttcagccttccaccaagggcccatcggtctcccctggcgcctgcctccaggagcacctctggggggcacaggcggccctggggctgcctgggtcaaggaactacttcctatatacctgtctgagcgggctggcaggcgcatag

SEQ ID NO: 790922 - DNA, 668 bp, Homo sapiens
  misc_feature: 20649.44.45.E01.1.pb.heavy.1.raw 20649
cgtatcgcctccctcgcgccatcagacagtatatacacgaccggtgctcgatttagtgagtcagtaagggaaaggggctgggagagagcccagcactagaagtcggcggtgtttccattcggtgatcagcactgaacacagaggactcaccatgggagtttgggctgagctgggtttcctcgttgctcttttaagaggtgtccagtgtcaggttcagctggtggagtctgggggaggcgtggtccagcctggacgctccctgagactctctgtgtttgcgtccggactcagtttcagtgactctgccatgcactggtccgccaggctccaggcaagggctggagtggggtggcagtcatctggtctgatggaagtaaagaatactatggaaactccgtgaagggccgattctccgtctcagagacaattccaagaacaccgtgtatctacaaatgaacaattgagagccgaggactcggctctctattattgtacggcatcgttctaccgggggccagggagccctgggtcaccgtctcctcagcctccaccaagggcccatcggtcttcccctggcgccctgctcaggagcacctcgagagcacagcggcctgggctggctggtcaaggactacttcctatatactgtctgagcgggctggcaaggc

SEQ ID NO: 790923 - DNA, 659 bp, Homo sapiens
  misc_feature: 20659.44.36.D03.1.pb.heavy.1.raw 20659
cagcccagggccgctgtgctctcggaggtgcctcctggagcagggcgccagggggaagaccgatgggcccttggtggaggctgaggagacggtgaccaggggttccctggccccagtggacagttcctgatataaacacaacacaataatacatgcccgtgtcctcggttttcaggttagtcattcgcagaatcaatgagttcttttgaagtcatctctttgagagggtgaatctggctttcacaggacgcggcgtactctgtgataaagcctggccaactttgtttttactgcggccaagccactccagccccttccctggagcctggcggacccagtccatatagtggtcactgatggtgaatccagaggcgacacaggagagtctcagggaccctccaggctggacaagtctccccggactccaccaactgcacttcactctggacaccttgtaaaataacaacaaggaaaacccagctcagcccgaactccatggtgagtcctctgtgttcagtgctgatcaccaaatgaaaaacctgggaattctggggctgggctccgctctcagagcctcccccaagagagaatcgtgacgcagctaaatcgagcaccggtcgtgtattatactgtctgatggcgcgagggaggcgatacgg

SEQ ID NO: 790924 - DNA, 724 bp, Homo sapiens
  misc_feature: 20681.UNK.UNK.UNK.pb.heavy.1.raw 20681
ctatgcgccttgccagcccgctcagacagtatataggcggaagtagtccttgaccaggcagcccagggccgctgtgctctcggaggtggctcctggagcagggcgccagggggaagaccgatggcccttggtgggaggctgaggagcggtgaccagggttccctggccccagtggacagttcctgatataaacacaacacaataatacatgcccgtgtcctcggttttcaggttagtcattcgcagaatcaatgagttctttgaagtcatctcttgagagggtgaatctggctttcacagacgcggccgtactctgtgataaaagctggcaactttgtttttactgcggccaagcaactccagccccttccctggagcctggcggacccagtccatatagtggtcactggatggtggaagtccagaggcgacacagagagtctcaggaccctccaggctggacccaagtctccccggactccaccaactgcacttcactctggacaccttgtaaaaataacaacaaaggaaaacccagctcagcccgaactccatggtgagtcctctgtgttcagtgctgatcaccaaaatgaaaacaccctgacactctgggattctgggggctggggctccgctctcagagctccccaagagaggattcgtgacgcagctaaatcgagcaccgtgtgttaatactgtctgatggcgccgaggaggcgatacg

SEQ ID NO: 790925 - DNA, 704 bp, Homo sapiens
  misc_feature: 20682.44.36.D03.1.pb.heavy.1.raw 20682
cgtatcgcctccctcgcaccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790926 - DNA, 708 bp, Homo sapiens
  misc_feature: 20690.UNK.UNK.UNK.pb.heavy.1.raw 20690
ctatgcgcctgccagcccgctcagacagtaataggaagtagtccttgaccaggcagcccagggcgctgtgcccccagaggtgctgcttcttggaggagggtgccagggggaagaccgatgggcccttggggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagaccccactccagccccttccctggagcctggcggacccaactcagtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgctaaatcgagccaccggtcgtgtatatactgtctgatggcgcgaagggaggcgatacg

SEQ ID NO: 790927 - DNA, 707 bp, Homo sapiens
  misc_feature: 20695.44.36.D03.1.pb.heavy.1.raw 20695
ctatgcgccttgccagcccgctcagacagtatataggaagtagtccttgaccaggcagcccagggccgctgtgctctcggaggttgctcctggagcagggcgccaggggaagaccgatgggccccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgaaaataaagctggcaactttgttttactgcggccaagccactccagcccctttccctggagcctggcggacccagtccatatagtggtcactgatgtgaatccagaggcgacacaggagagtctcagggaccctccaggctggaccaagtctcccccggactccaccaactgcacttcacttggacaccttgtaaaataacaacaaggaaaaacccagctcagcccgaactccatggtgagtcctctgtgttcagtgctgatcaccaaatgaaaacacctgggaattctggggctggggctccgctctcagagctcccaagagagatcgtgacgcagctaaatcgagcaccggtcgtgtatatactgtctgatggcgcgagggaggcgatacg

SEQ ID NO: 790928 - DNA, 620 bp, Homo sapiens
  misc_feature: 20702.44.23.C01.1.pb.heavy.1.raw 20702
cgtatcgcctccctcgcgccatcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggatggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggcccgtggcaccctggtcactgtctcctcagcttccaccaagggcccatcggtcttccccctggcgccctgctccaggagcacctctgggggcacagcggcctgggctgcctggtcaaggactacttcctatatactgtctgagcgggctggcaaggcgcatag

SEQ ID NO: 790929 - DNA, 576 bp, Homo sapiens
  misc_feature: 20708.44.37.D04.1.pb.heavy.1.raw 20708
cgtatcggcctccctcgcgccatcagacagtattataccacgaccggtgctcgatttagtagcatactgttgggtttggggaggcgtggtccagccgggaggtccctgagactctcctgtgtagcctcctgggttctcattcgatagattttggtttgcactgggtccgccaggctcccaggcaagggggcccgagtgggtggcagtcatctccgacgatggaagtgagaatattactcagactccgtgaagggccgattcaccatctccagagacaattccaagaatatgtgtatttgcaaatgaacagcgtgagagttgacgacacgtctgtttattaactgtgcgagggggacctccaaggaaacggttcggggaatcataaactactactatttgatggatgtctggggcagggggacgtcggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 790930 - DNA, 706 bp, Homo sapiens
  misc_feature: 20719.44.62.F07.1.pb.heavy.1.raw 20719
ctatgcgccttgccagcccgctcagacagtatataggaagtagtccttgaccaggcagccagggccgctgtgctctcggaggtgctcctggagcagggcgccagggggaagaccgatgggcccttggtggaggctgaagagacggtcaccactgtcccccggccccaagtactaaaggtgtcatggggggtcaccgtggtcctggctttcaaacagtaatagacgcctgtgtcctcgggtctcaggtttttcatttggagaaacaatttgtcctgcgaattgtccctggaaatggtgaagcggcccttcacggagtctccgtagaagtgacaccaccagctccgatacttgagacccactccagtccctccctggagcccggcggaccaggtcatgccataggcactaaaggtgaatccagaggccgcacaggagagggtcaggacctcccaggccgaatcaggccccccccagactccaacaactgcacttcacacacgacaccctttaaaaaagccacaagaaaaaggcagctcagcccaaactccatggagacttctctctgttcggtcctggtcaccaaatgaagacacctgaaaatcccagggctgggctcctctctcagagctccctttccctttatgcgactactaaatcgagcaccggtcgtgtatatactgtctgatggcgcgagggaggcgatacg

SEQ ID NO: 790931 - DNA, 665 bp, Homo sapiens
  misc_feature: 20727.UNK.UNK.UNK.pb.heavy.1.raw 20727
cgtatcgcctccctcgcgccatcagacagtatatacacgaccggctcgattagctacgactgcaagggaaaggggagagggagccttagccctggactccaaggcctttcacttgtgatcagcactgagcacagaggactcaccatggaattggactgagctgggtttccttgttgctatttagaggtgtcagtgtgaggtgcaactggtgagtctgggggaggcttggtccagcctgggggtccctgagactctcctgtgcagcctctggattcacctttagtagttattggatgaactgggtcgccaggctccaggaagggctggagtggtggccatcatgaagaaagatggaactgagacacactatgtggactctgtgaagggccgattcaccatctcagagacaacgccaagaactcactgtatctgcaaatgacagtctgagagtcgaggacacggctgtgtattattgtgcgggaggcgctgggtgctcatgacactggggcaggaaccctggtcaccgtctcctcagctccaccaaggccatcggtcttcccctggcgccctgctccaggagcacctccgagagcacagcggccctgggctgcctggtcaaggactacttcctatatactgtctgcgcgggctggcaaggcgcatag

SEQ ID NO: 790932 - DNA, 696 bp, Homo sapiens
  misc_feature: 20732.UNK.UNK.UNK.pb.heavy.1.raw 20732
ctatggcgccttgccagcccgctcagacagtatataggaagtagtccttgaccaggcaggccagggccgctgtgccccccagaggtgctcttggaggagggtgccagggggggaagaccgatggcccttggtggaggcggaggcgacggtgaccaggttcctggccccagaagtcaacgaataataaccactccgagcgccgacttgtctcgcacagtaatagacggccgtgtcgtcgcctctcaggttgttcatttgagataaaccgtgttcctggaattgtccctggagatggtgaatcggcccttcacggagtctgcgtagtatgtgaatcaccagtataaatgactgagacccactccagccccttccctggagctgcgacccaactcatgtagttgctggctgacggtgaggcccagagcctgcacagagagtctctgggaccccccaggctggactaagcctcctccagactccatcagccgcacctcacactggacacttttaaaagtccaacaagagaacccagctcagccaaaactccatggtgagtcctctgtgttcagtgcgatcaccgaatggaaaacactcggaatcccagtgctgggggcctctctcccaaaccaacgtggcgagtgctaaatcgagcaccgggtcgtgtatatactgtctgatggcgcgagaggcgatacg

SEQ ID NO: 790933 - DNA, 669 bp, Homo sapiens
  misc_feature: 20756.UNK.UNK.UNK.pb.heavy.1.raw 20756
ctatgcgccttgccagcccgccagacagtatataggaagtagtccttgaccaggcagcccagggccgctgtgccccagaggtgctcctggagcaggggcgcccagggggaagaccgatggggcccttggtggaagctgaaggagacagtgaccagggtgccacggccccatagattgaaagaccagtctctcgcctcgcaacagaaaataaacggccgtgtccgcggcggtcacggaggtcagtttcagggagaagcggttcatggacgtgtcctctcgaaatggtgagacgactccttgagggacggagagtagtaacgtcggccccagtataatggatgtcaccaatccactccatttcccctccatctgggggctgccggatccagccccaagaatgatcagaaactgatggaaactccagagacagtgcagaatgagagacagggttcccgaaggcctcaccagtcctggccgactcctgcgctgcacctgggacagggacccatctgggagctgccaccagcaggaggaaaaaccacaggtgcttcatgttcttgcacaggaggttccttgactctcagaaagcatccccaaaaccccaagtctatagcactaaatcgagcaccgtcgtgtatatactgtctgatgcgcgagggaggcgatacg

SEQ ID NO: 790934 - DNA, 758 bp, Homo sapiens
  misc_feature: 20759.44.39.D06.1.pb.heavy.1.raw 20759
cgtatcggccctccctcgcgccatcagacagtatatacacgaccggtgctcgatttagtgacatctcgcagttctttgggggagagacgagcccagcactggaagtcgcgcggtgtttccattcggtgatcatcactgaacacagagggactcaccatggagtttgggcctgaagctgggtttttcctcgttgcttcttttaagaggtgtccagtgtcaggagcactttggtggagtctgggggaggcgtgggtccagccccgggaggtccctgagactctcctgtgtagccctctgggttcttcattcgatagatttggtttgcactgggtccgccaggcttccaggcaaggggccggagtgggtggcagtcatctccgacgatggaagtgagaagtattactcagactccgtgaagggccgattcaccatctccagagacaattccaagaaatatgctgtatttgcaaatgaacagcgtgagagttgacgacacgtctggtttattactgtgcgaggggggacctccaaggaaacggttcggggaattcataaactactactatttgatggatgtctgggggcagggggggacgtcggtaccgtctctcctcagcttccaccaaggggcccatcggtcttccccctgggcgccctgctccaggagcacctctgggggcacagcggccccctggggcctgcctggtcaaggactacttcctatatactgtctgaggcggggctggcaaggcgcatag

SEQ ID NO: 790935 - DNA, 731 bp, Homo sapiens
  misc_feature: 20778.44.33.C11.1.pb.heavy.1.raw 20778
cgtatcgcctccctcgcgccatcagacagtatatacacgaccggtgctcgatttagagtgagctcgttggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttcccctggcaccctcctccaagagcacctctggggggcacagcggccctgggctgcctggtcaaggactacttcctatatactgtctgagcgggctggcaaggcggcatag

SEQ ID NO: 790936 - DNA, 720 bp, Homo sapiens
  misc_feature: 20796.UNK.UNK.UNK.pb.heavy.1.raw 20796
ccgtatcgccctccctcgccgccatcagaccagtatatacagaccggtgctcgatttagtgtcgtcgcaagagagaggagccccagccgtgagattcccaggagtttccacttggtgatcagcactgaggcacagaccaccaaccatggagtttgggctaatcttgattttcccttgtagtttttttagaaggtggtcccagtgcgaggggcgactggcggagtcggggggggctggacacagccaggggcggtctctgaggactctcctgtgtagtctcaggattcagtcttagtgattatcacttgggcctggttccgtcaggctcccagggaagggccttgagtggatcactttcgtcagaatgaaacgttatgggtggaagtaaagagtacgcccgcgtctgtggaaggggaagattcacctcctcaagggatgactccaaccagtgttggccatttacaaaatgagcaactgagacccgacgacacaggcgtctattactggcgccaggcgatcctggggacgtcgatgcatttgatatttggggccaggggacaatggtccccaccgtctctcagcttccaccaagggccccatcggtcttccccctggcgccctgcttccaggagcacctctgggggcacagcggccctgggctgccctggtcaaggactacttcctatatacctgtctgagcgggctggaaggccggcatag

SEQ ID NO: 790937 - DNA, 678 bp, Homo sapiens
  misc_feature: 20833.UNK.UNK.UNK.pb.heavy.1.raw 20833
ctatgcgctttgccagcccgctcgacagtatataggaagtagtccttgaccaggcagcccagggccgctgtgccccagaggtgctcctggagcagggcgccaggggaagaccgatgggcccttggtggagctgaagagacgggtgaccatgtccctggccccaaatatcaaatgcatcgacgtcccagatcgcctggcgcagtaatagacgcctgtgtcgtcggtctcaggttgctcatttgtaatggccaacactgttggagtcatccccttgagacggtgaatcttcccttcacagacgcggcgtactctttacttccaccataacgtttcattctgacgaaagtgatccactcaagccccttccctggagcctgacggacccaggccaagtgataatcactaagactgaatcctggactacacaggagagtctcagagaccgccctggctgtgccagcccccgccgactccgccagtcgcccctcgcactggacaccttctaaaaaactacaggaaaatcaagattagcccaaactccatggttggtggtctgtgctcagtgctgatcaccaagtggaaactcctgggaatctcacggctggggctcctctctcttgcgacgacactaaatcgagcacgtcgtgtataactgtctgatgggcggagggaggcgat

SEQ ID NO: 790938 - DNA, 651 bp, Homo sapiens
  misc_feature: 20834.44.23.C01.1.pb.heavy.1.raw 20834
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagcccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcccccaatccctaatcacgtgtactaaatcgagcaccggtcgtgtatatactgtctgatggcgcgaggaggcgatacg

SEQ ID NO: 790939 - DNA, 685 bp, Homo sapiens
  misc_feature: 20839.UNK.UNK.UNK.pb.heavy.1.raw 20839
ctatgcgccttgccagccccgctcagacagtatataggaagtagtccttgaccaggcagcccagggcgctgtgcccccagaggtgctcttggaggaggggtgccagggggaagaccgatggccttggtggaggctgaggagacggtgacagggttcccctgcgccccaagtggtcaaagtagttggtgacgaactgccctactctcgcacagtaatacacggcgtgtccgcggggcgtcacagagctcagcttcagggagaactggttcttggacgtgtctactgatatggtgactcgactcttgagggacgggttgtagtaggtgctccactatagatagatactccgcaatccactccagccccttcccctggggggctggcgggatccagcccccagtaggtaactacctgctgcctgatggagccaccagagacagtgcaggtgagggacagggtcccgaaggcttcaccagtcctggggccccgactcctggcagctgcagctgggacaggacccattctgggagccgccaccagcaggaggaagaacccacaggtgcttcatgttcttgcacaggacggtccatgactctcagaaaggcccccccgcggaatctacactactaaatcgagcaccgggtcgtgtatattactgtctgatggcgcgagggaggccgatacg

SEQ ID NO: 790940 - DNA, 692 bp, Homo sapiens
  misc_feature: 20855.44.55.E11.1.pb.heavy.1.raw 20855
cgtatcgcctccctcgcgccatcagacagtatatacacgaccggtgctcgatttagcactcgcacgttgggtttggggagaggagccccagcactgggattccgaggtgttccattcggtgatcagcactgaacacagaggactcaccatgggttttggctgagctgggctgctccttgttggacttttaaaaggtgtccagtgtgagtgcggctgatgggagtctggaggaggcttagtccgccgggggtccagagactctcctgtgcagcctctggctcaccgtcagcagcactacatgagttgggtccgccaggctccagggaaggggctggagtgggtctccagtcatttatactggtgatttcacatactacgcagactccgtgaagggcgattcaccatctccagggacaattccaggacacggtttatcttcaaagaacaacctgagaggcgacgacacggccgtctattactgtgcgagacaagtcggcgctcggagtggttattattcgttgacttctggggccagggaaccctggtcaccgtcgctcgccgtccaccagggccatcggtcttcccctggcaccctcctccaagagcacctctggggcacagcgggcctgggctgcctggtcaaggactacttcctatatactgcgttctgagcgggctggcaaggcgcatag

SEQ ID NO: 790941 - DNA, 654 bp, Homo sapiens
  misc_feature: 20857.44.86.H09.1.pb.heavy.1.raw 20857
cgtatcgcctcctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcacgtgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaaactgacctccgtgaccgccgcggacacggccgtttatttctgtgcgaggcgagactggtctttcaatctatggggcgtggcaccctggtcactgtctcctcagcttccaccaagggcccatcggtcttccccctggcgccctgctccaggagcacctctgggggcacagcgccctgggctgcctggtcaaggactacttcctatatactgtctgagcgggctggcaaggcgcatag

SEQ ID NO: 790942 - DNA, 687 bp, Homo sapiens
  misc_feature: 20880.44.53.E09.1.pb.heavy.1.raw 20880
cgtatcgcctccttcgccgccatcagacagtatatacacgaccggtgctcgatttagagagagtgtgttgagctctgggagaggaagccccaggccttgggattcccaggtggttttcattcagtgatcaggactgaacacagaggactcaccatggagtttgggctgagctggattttccttgctgctattttaaaaggtgtccagtgtgaggtgcagttggtggagtctgggggaggtttggtaaagcctggggagtcccttagactctcctgtgcagcctctgggattcactttcagtaacgcctggatgacctgggtccgccaggctccagggaagtgggctggagtgggttggccgtattagaaccaaagctgacggggacagcagactacgctgcaccgtgaaaggcagaattcaccatctcaagagatgatcaaaagatacggtgtctctgcagatgaacagcctgaacaccgaggacacagccgtctattactgtctgggatggtttcattcgggccagggaaccctggtcaccgtctcctcagcctccaccaagggcccatcggtcttccccctggcgccctgctccaggagcacctccgagagcacagcggcctgggctgcctggtcaaggactacttcctatatactgtctgagcgggctggggcaaggcgcatag

SEQ ID NO: 790943 - DNA, 660 bp, Homo sapiens
  misc_feature: 20900.UNK.UNK.UNK.pb.heavy.1.raw 20900
cgtatcgcctcctcgcgccatcagacagtatatacacgaccgtgctcgattagatctactgacaaccacatcctcctctaaagaaccccctgggagcacagctcatcaccatggactggacctggaggttcctcttgtggtggcagcagcaacaggtgtccagtcctggtgcaactggtgcagtctggactagaatgccgcacctggtcctcggtgaccctttcctgcacggcctctggagtactaccagttccactacttataccatcaactgggtgcgccaggcccctggacaagggcttgagtggatgggtggaatcatccctcttttggctcactcacctacgcacgagacttccgggcagattacgattaccgcggacaagtccacagacacagtctccatgacaatgagttctttgaaatcgacgacacggccgtctactactgtgcgagaggtccgtacccagctcgcatggagcctttgagatctgggggcagggaaccctggtcattgtcacctcagcttccaccaagggcccatcggtcttcccctggcgccctgctccaggagcacctctgggggccacagcggccctgggctgcctggtcaaggactacttcctatatactgtctgagcgggctggcaaggcgcatag

SEQ ID NO: 790944 - DNA, 711 bp, Homo sapiens
  misc_feature: 20923.44.36.D03.1.pb.heavy.1.raw 20923
ctatgccgccttgccagcccgctcagacagtatataggaagtaagtcctttgaccaggcagcccaggggcgctgtgctctcggaggtgcttcctggagccaggcgcccagggggaagaccgatgggcccttggtggaggctgaggagacggtgaccagggttccctggcccagtggaccagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccgccttccctggagcctggcggacccagtccatatagtggtcactgatggtgaatccagaggcgacacaggagagtctcaggaccctccaggctggaccaagtctcccccggactccaccaactgcacttcactctggacaccttgtaaaataacaacaggaaaacccagctcagcccgaactccatggtgagtcctctgtgttcagtgctgatcagccaaatgaaaacacctgggaattctggggctgggtgctccgctctcagagctcccaagagagatcgtgacgcagctaaatcgagcaccggtcgtgtatatactgtctgatggcggcgagggaggcgatacg

SEQ ID NO: 790945 - DNA, 666 bp, Homo sapiens
  misc_feature: 20941.44.29.C07.1.pb.heavy.1.raw 20941
cgtatcgcctccctcgcgccatcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctgggtccgtcagccccccaggaaaggccctggagtggcttgcactcatttattgggatgatgataggcgctacagtccatctctgaagagcagactctccatcaccggagacgcctccaatacgcaggtgatccttagagtggccaacatggccccctgcggacacagccacatactactgcgcacacatgatcaactattataaaagtggtggttatgtgagtggctttgatatctggggccaagggacaatggtcaccgtctcttcagcctccaccaagggcccatcggtcttccccctggcgccctgctccaggagcacctccgagaacacagcggccctgggctgcctggtcaaggactacttcctatatactgtctgagcgggctggcaaggcgcatag

SEQ ID NO: 790946 - DNA, 699 bp, Homo sapiens
  misc_feature: 20970.44.45.E01.1.pb.heavy.1.raw 20970
cgtatcgcctccctcgcgccatcagacagtatatacacgaccggtgctcgatttagtgagtcagtaagggaaaggggctgggagaggagcccagcactagaagtcggcggtgtttccattcggtgatcagcactgaacacagaggactcaccatggagtgttgggctgagctgggttttcctcgttgctcttttaaagaggtgtccagtgtcaggttcagctggtgggagtctgggggaggcgtggtccagcctgggaccgtccctgagactctcctgtgttgcgtccggactgctcgagtttcagtgactctgccatgcactgggtccgccaggctccaggcaacgggctggagtgggtggcagtcatcgggtctgatggaagagtaaagaatactatggaaactccgtgacagggccgattctccgtctccagagacaattccaagaacaccgtgtatctacaaatgaacaatttgagagccgaggactcggctctctggattattcgtacgagcccatcgttctactcgcggccaggagccctggtcaccgtctcctcagcctccaccaaagggcccatcggtcttcccctggcgccctgctccaggagcacctccgagagcacaagcgccctgggctgcctggtcaagggactacttcctatattactgtctgagcgggctggcaaggcgcatag

SEQ ID NO: 790947 - DNA, 690 bp, Homo sapiens
  misc_feature: 20975.UNK.UNK.UNK.pb.heavy.1.raw 20975
ctatgcgccttgccagcccgctcagacagtatataggaagtagtccttgaccaggcgcagccccgggccggctgtgccccagaggtgctcttggagcgacggggggtgccaggggaagaccgatgggcccttggtggaggctgagggacggtgaccagggttccctggccccagtggtcaaagtagttggtcgacgaactgccctactctcgcacagtaatacacggccgtgtccggcggcggtcaccagagctcagcttcagggagaactggttcttggacgtgtctactgagtatggtgactcgactcttgagggacgggttgtagtaggtgctcccactataatagatactcccaatccactccagccccttccctggggggctgggcggatccagcccccagtagtaactactactggctgatggagccaccagagacagtggcaggtgaggcgacagggtctccgaaggcttcaccagtcctgggcccgactcctgcagctgcagctgggacaggacccatctggggagccgccaccagcaggaggaagaaccacaggtggcttcatggttcttgcacaggaggtccatccgactctcagaaagcccccgcggaatctacacctactaaatcgagccaccgttgggtgtatatactgtctggatggcgcgaggggaggcgatacg

SEQ ID NO: 790948 - DNA, 717 bp, Homo sapiens
  misc_feature: 20982.44.85.H08.1.pb.heavy.1.raw 20982
cgtatcgcctccctcgcgccatcagacagtatatacacgaccggtgctcgatttagtatcactcagtcgcgggagctctgggagaggagcccagcactagaagtcggcggtgtttccattcggtgatcagcactgaacacagaggactcaccatggagtttgggctgagctggttttcctcgttgctcttttaagaggtgtccagtgtcaggtgcagctggtggagtctgggggaggcgtggtccagcctggaggtccctgagactctcctgtgcagcgtctggattcaccttcagtacctatgcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctggactactactacggtatggacgtctgggccaagggaccacggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 790949 - DNA, 692 bp, Homo sapiens
  misc_feature: 20997.44.19.B08.1.pb.heavy.1.raw 20997
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggctccctggccccagtagaacgatgggctcgtacaataatagagagccgagtcctcggctctcaaattgttcatttgttagatacacggtgttcttggaatttgctttcttggagacggagaatcgggcccttcacggagtttccatagtattctttacttccatcagaccagatggactgccacccactccagccccttgcctggagccctggcggacccagtgcatggcagagtcactgaaactgagtccggacgcaacacaggagagtctcagggacgtcccaggctggaccacgctccccccagactccaccagctgaacctgacactggacacctcttaaaagagcaacgaggaaacccagctcagcccaaactccatggtgagtcctctgtgttcagtgctgatcacgggaatggaaacaccgccgacttctagtgctggggctcctctcccagcccctttcccgttactgactcactaaatcgagcaccggtcgtgtatatactgtctgatggcgcgagggaggcgatacg

SEQ ID NO: 790950 - DNA, 596 bp, Homo sapiens
  misc_feature: 21014.44.36.D03.1.pb.heavy.1.raw 21014
cgtatcgcctccctcgcgccatcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatggtgtagctggatccgtcagccccagggaaaggccctgagtggcttgcacacatcttctcgaatgacgaaaaatcctacagtacatctctgaagagcagtttaaccatctccaaggacactccaaaaggcaggtggtctttagtatgaccaacatggaccctgcgggacacaggcacatattactgtgcacgggtaatgcgggaaagaaacagctggtttctgtattataagtcttacatctggacgtctgggcaaagggaccacggtcaccgtctcctcagcttccaccaagggcccatcggtcttccctggcgccctgctccaggagcacctctgggggcacagcgccctgggctgcctggtcaaggacacttccttatactgtctgagcggctgcaaggcgcatag

SEQ ID NO: 790951 - DNA, 691 bp, Homo sapiens
  misc_feature: 21017.44.27.C05.1.pb.heavy.1.raw 21017
ctatgcgcctgccagcccgctcagacagtatataggaagtagtccttgaccaggcagccagggccgctgtgctctcggaggtgctcctggagcagggcgccagggggagaccgatgggccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagccctcgcctggagcctggcggacccactgcatattccattatcgaaggtgaatccagagctgcacaggagagtctcagggaccccctactggggccacgcctccccagactccacgaattgcacctgacacatgacacctcttaagagggcaacgaggaaaacccagctcagcccaaactccatggtgagtcctctgtgttcagtgatgatcaccgagtggaaacaccggcgactccagtgctgggctcgtctcccagccccaaacctcgatcgcgtctaatcgagcaccggtcgtgtatatactgtctgatggcgcgagggaggcgatacg

SEQ ID NO: 790952 - DNA, 694 bp, Homo sapiens
  misc_feature: 21025.44.27.C05.1.pb.heavy.1.raw 21025
cgtatcgcctccctcgcgccatcagacagtatatacacgaccggtgctcgatttagacgcgatcgaagggtttgggctgggagacgagccagcactggaagtcgccggtgtttccactcggtgatcatcactgaacacagaggactcaccatggagtttgggctgagctgggtttttcctcgttgccctcttaagaggtgtcatgtgtcaggtgcaattcgtggagtctggggaggcgtggccccagtagggggtccctgagactctcctgtgcagcctctggattcaccttcgataattggaatatgcagtgggtccgccaggctccaggcgaggggctgagtgggtggcagtgtgtcatttcatggaggaaatcaagtctaccggtgattccgttgaggccgattcaccatctccagagacaattccgagaacacagtgtctcttcaaatgaacagcctgagacctcaggacacggccgtgtatttttgtgcgagactatctgtttcaaaatcggttcattcgacgcctggggccagggaaccctggtcaccgtctcctcgcctccaccaagggcccatcgtcttccccctggcgccctgctccaggagcacctccgagagcacagcggccctggctgcctggtcaagactacttcctatatactgtctgagcgggctggcaaggcgcatag

SEQ ID NO: 790953 - DNA, 646 bp, Homo sapiens
  misc_feature: 21058.44.19.B08.1.pb.heavy.1.raw 21058
cgtatcgcctccctcgcgccatcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcagccccccggaaaggccctggagtggatcgcactcacttattggaatgacgatatacgatatagtccttctctgacgaccagactcacgctcacgaaggacacgtccaaaaaccaggtggtccttacattgaccaacgtggaccctgtggacacaggcacatatttctgtgcccacttcatgaccacaatgaccacgggcttcttcgaaccctggggccagggaatccaggtcaccgtctcatcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790954 - DNA, 677 bp, Homo sapiens
  misc_feature: 21075.44.36.D03.1.pb.heavy.1.raw 21075
ctatgcgccttgccagcccgtcagacagtatataggaagtagtccttgaccagcagccagggcgctgtgctctcgaggtgctcctggagcagggcgccaggggaagaccgatggcccttggtgaggctgaggagacggtgaccagggtccctggccccagtggacagttcctgatataaacacaacacaataatacatgccgtgtcctcggtttcaggttagtcattcgcagaatcaatgagttcttgaagtcatctcttgagagggtgaatctgctttcacagacgcggcgtactctgtgataaagctggcaactttgttttactgcggccaagcactcagcccttcctggagcctggcggacccagtccatatagtggtcactgatggtgaatccagaggcgacacaggagagtctcagggacctccaggctggaccaagtctccccggactccaccaactgcacttcactctggacaccttgtaaaataacaacaaggaaaaccagctcagcccgaactccatggtgagtcctctgtgttcagtgctgatcaccaaatgaaaacacctggaattctggggctgggctccgctctcccccaagagagatcgtgacgcagctaaatcgagcaccggtcgtgtatatactgtctgatggcgcgagggaggcgatacg

SEQ ID NO: 790955 - DNA, 682 bp, Homo sapiens
  misc_feature: 21121.44.36.D03.1.pb.heavy.1.raw 21121
ctatgcgccttgccagccgctcagacagtatatagggaagtagtccttgaccaggccagcccagggccgctgtgctctcggaggtggctcctggagcaggcgccaggaagacgatgggcccttggtgaggcgaggagacggtgaccagggttccctggccccagtggacagttcctgatataaacacaacacaataatacatgccgtgtcctcggttttcagttagtcattcgcagaatcaatgagttcttgaagtcatctcttgagagggtgaatctggcttcacagacgcgcgtactctgtgataaagctggcaactttgttttactgcggccaagccactcgccccttccctggagcctggcgacccagtccatatagtggtcactgatggtgaatccagagggcgaccacaggagagtctcagggaccctccaggctggaccaagtctcccccggactcaccaactgcacttcactctggacaccttgtaaaataacaacaaggaaaacccagctcagccgaaactccatggtgagtcctctgtgttcagtgctgatcaccaaatgaaaacacctggaattggctggctccgctctcagagctcccagagagatcgtgacgcagctaatcgagcaccggtcgtgtatatactgtctgatggcgcagggaggcgatacg

SEQ ID NO: 790956 - DNA, 697 bp, Homo sapiens
  misc_feature: 21124.44.55.E11.1.pb.heavy.1.raw 21124
cgtatcgcctccctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggagaggcttagtccagcctgggggtcccagagactctcctgtgcagcctctgggctcaccgtcagcagcaactacatgagttgggtccgccaggctccagggaaggggctggagtgggtctcagtcattatactggtgatttcacatactacgcagactccgtgaaggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttcccctggcaccctcctccaagagcacctctggggcacagcggccctgggctgcctggtcaaggactacttcctatatactgtctgagcgggctggcaaggcgcatag

SEQ ID NO: 790957 - DNA, 715 bp, Homo sapiens
  misc_feature: 21135.44.85.H08.1.pb.heavy.1.raw 21135
cgtatcgcctccctcgcgccatccagacagtatatacacgaccggtgctcgatttagtatcactcagtcgcgggagctctgggagaggaggccagcactagaagtcgcggcggtgtttccatctggtgatcagcactgaacacagaggactcaccatggagtttgggctgagcctgggttttcctcgtttgctcttttaagaggtgtccagtgtcaggtgcagctggtggagtctgggggaggcgtggtcagcctgggaggtccctgagactctcctgtgcagcgtctggattcacctcagtacctatggcatgcactgggtccgccaggctccaggcaaggggctgagtgggtggcacttatatggtatgatggaagtaataaatactatgcagactccgtgaaggccgattcaccatctccagagacaattccaagaacacgctgtatctgcaaatgaacagcctgagagcgaggacagctgctgtgtattactgtgcgaggacatattgtagtactaccacctgctgggactactactacgtatgacgtttggggccaaggaccacggtcaccgtctctcagcctccaccaagggccccatcgtcttcccctggcaccctcctccaagagcacctctgggggcacagcggcctgggctgcctggtcaaggactattcctatatactgtctgagcgggctgcaaggcgcatag

SEQ ID NO: 790958 - DNA, 1376 bp, Homo sapiens
  misc_feature: 21171.44.33.C11.1.pb.heavy.1.raw 21171
cgtatcgcctccctcgcgccatcaagcagtatatacacgaccggtgctcgatttagagtgagctcgttgggtttggggagctctgggaagagagcccagcaccagaagtcggcggtgtttccagtcggtgatcagcccgaacacagaggactcaccatggagtttgggctgacctgggttttcctcgttgctctttaagaggtgtccagtgtcaggtgaagctggtggagtctggggaggcgtgtccagcctggaggtccctgagactctcctgtgtagcgtctggattcaccttcacagacatggcatgcactgggtccgccaggctccaggcaagggactggagtggtggcacttatatggtatgatggaagtaataaatattatgtagattccgtgaagggccgattcaccatctccagagacaattcgaagaacacctatatctgaaatgaatagcctgagagccgaggacacggctgtctactactgtgcgagagatgggctcgtggatacagatatgacaatgctctacccaatggtatggacgcctgggggccaagggaccacggtcgccgtctcctcagctccaccaagggcccatcggtcttccccctggcacccctcctccaagagcacctctgggggcacagcgccctgggctgcctggtcaaggactacttcctatatactgtctgagcgggctggcaaggcgcatagctatgcccttgccagcccgctcagacagtatataggaagtagtccttgaccaggcagcccagggccgctgtgccccagaggtgctcttggaggagggtgccaggggaagaccgatgggcccttggtggaggctgaggagacggtgaccagggtccctggccccagtggtcaaagtagtggtgacgaactgcctactctcgcacagtaatacacggccgtgtccagcggcggtcacagagctcagcttcagggagaaactggttcttggacgtgtctactgatatggtgactcgactcttgaggacgggttgtagtaggtgctcccactataatagatactcccaatccactccagcccttccctgggggctggcggatccagccccagtagtaactactactgctgatggagccaccagagacagtgcaggtgagggacaggtctccgaaggcttcaccagtcctgggccgactcctgcagctgcagctgggacaggacccatctgggagccgccaccagcaggaggaagaaccacagtgcttcatgttcttgcacaggaggtccatgactctcagaaagccccgcggaatctacactactaaatcgagcaccggtcgtgtatatactgtctgatggcgcgaagggaggcgatacg

SEQ ID NO: 790959 - DNA, 672 bp, Homo sapiens
  misc_feature: 21182.44.35.D02.1.pb.heavy.1.raw 21182
cgtatcgcctccctcgcgccatcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggtacatcagtagttattattggagttgcctgcggcagtccgccgggaagggactggagtggattgggcgcatctataacagtggcagcaccaactacaaccccgcctcaagagtcgagtcaccatgtcactagacaggtccaagaaccagttctccctgaattgacttctgtgaccgccgcggacacggccgtatattattgtgcgagagattcctatcgatacagtagagacgggggggcgaactggctcgacccctgggccagggaaccctggtcaccgtctcctcagcctccaccaagggccatcggtcttccccctggcaccctcctccaagagcacctctgggggcacagcggccctgggctgctggtcaaggactacttcctatatactgtctgagcgggctggcaaggcgcatg

SEQ ID NO: 790960 - DNA, 709 bp, Homo sapiens
  misc_feature: 21201.44.27.C05.1.pb.heavy.1.raw 21201
ctatgcgccttgccagccccgctcagacagtatataggaagtagtccttgaccaggcaggcccagggccgctgtgctctcggaggtgctcctggagcaggcgccaggggaagaccgatgggcccttggtggagggccgaggagaccggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaaatccagaggctgcacaggagagtctcagggacccccctactggggccacgcctcccccagactccacgaattgcacctgacacatgacacctccttaagagggcaacgaggaaaacccagctcagcccaaactccatggtgagtcctctgtgttcagtgatgatcaccgagtggaaacaccggcgacttccagtgctgggctcgtctcccaggccccaaacccttcgatcgcgtctaaatcgagcaccggtcgtgtatatactgtctgatggcgcgagggaggcgatacg

SEQ ID NO: 790961 - DNA, 570 bp, Homo sapiens
  misc_feature: 21203.44.78.H01.1.pb.heavy.1.raw 21203
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggcccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggcttcttcacctcagcagcgtggtgaccgtgactccagcaacttcggcacccaaacccaaactactcacactaaatcgagcaccggtcgtgtatatactgtctgatggcgcgagggaggcgatacg

SEQ ID NO: 790962 - DNA, 684 bp, Homo sapiens
  misc_feature: 21281.44.53.E09.1.pb.heavy.1.raw 21281
cgtatcgcctccctcgcgccatcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtctgggggaggtttggtaaagccttgggagtcccttagactctcctgtgcagcctctggattcactttcagtaacgcctggatgacctgggtccgccaggctccagggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattacttgtctgggatggtttcattcgggccagggaaccctggtcaccgtctcctcagcctccaccaagggcccatcggtcttccccctggcgccctgctccaggagcacctccgagagcacagcggcctggctgcctggtttcaagaactacttcctatatactgtctgagcgggctggcaaggcgcatag

SEQ ID NO: 790963 - DNA, 722 bp, Homo sapiens
  misc_feature: 21319.44.85.H08.1.pb.heavy.1.raw 21319
cgtatcgcctccctcgcgccatcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagcctgagaggccgaggacacggctgtgtattactgtgcgaggacatattgtagtactaccacctgctgggactactactacggtatggacgtctggggccaagggaccacggtcaccgtctcctcagcctccaccaagggcccatcgtcttcccctggcaccctcctccaagagcacctctgggggcacagcggccctgggctgcctggtcaaggactacttcctatatactgtctgagcgggctggcaaggcgcatag

SEQ ID NO: 790964 - DNA, 592 bp, Homo sapiens
  misc_feature: 21360.UNK.UNK.UNK.pb.heavy.1.raw 21360
aggctgggcaggctatgcaccctggtccaggtcaaaagctgcggaaccgctagcggcatcttggccactaggggtcccgcagattcatattgtcgtctagcatgcacaatgctgcaaccagcttgcaatgccacagcaagcggcaatctttacgccacgttgaattgtttattacctgtgactggctatggcttgcaacgccactcgtaaaactagtactttgcggttagggaagtagacaaacccattacccactcccggaagttcaactcattcaacacgaaataaaagtaaactcaacacccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcagttaggtcatcccagacgcatctggcgcctaaacgttcagtgggtagctaaggcgtcacctcgactgtctaaaggcaatatgtcgtccttagctccaagtccctagcaagcgtgtcgg

SEQ ID NO: 790965 - DNA, 659 bp, Homo sapiens
  misc_feature: 21365.UNK.UNK.UNK.pb.heavy.1.raw 21365
ctatgcgccttgccagcccgctcagacagtatataggaagtagtccttgaccaggcagcccagggccgctgtgcccccagaggtgctcctggagcaggggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcattggacgtgtccctcgaaatggtgagacgactcttgagggacggagagtagtacgtcgccccagtataatggatgtcaccaatccactccattcccctccctgggggggctgccggatccagccccaagaatgatcagaactgatggaaactccagagacagtgcagatgagagacagggttcccgaaggcctccaccagtcctgggcccgactcctgcagctgcacctgggacaggacccatctgggagctgccaccagcaggaggaaaaaccacaggtgcttcatgttcttgcacaggaggtccttgactctcagaaagcatcccaaacccaagtctatagcactaaatcgagcaccgtcgtgtatatactggtctgatggcgcgagggaggcgatacg

SEQ ID NO: 790966 - DNA, 664 bp, Homo sapiens
  misc_feature: 21397.44.12.B01.1.pb.heavy.1.raw 21397
cgtatcgcctccctcgcgccatcagacagtatatacacgaccggtgctcgatttagtagtgtagattccgcggggctttctgagagtcatggacctcctgtgcaagaacatgaagcacctgtggttcttcctcctgctggtggcggctcccagatggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgacactgggggccagggaaccctggtcaccgtctcctcaggcctccaccaagggcccatcggtcttcccctggcaccctcctccaagagcacctctggggggcacagcggccctgggctgcctggtcaaggactacttcctatatactgtctgagcgggctggcaaggcgcatag

SEQ ID NO: 790967 - DNA, 616 bp, Homo sapiens
  misc_feature: 21434.44.27.C05.1.pb.heavy.1.raw 21434
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggaccactgcatattccaattatcgaaggtgaatccagaggctgcacaggagagtctcagggaccccccctactggggccacgcctcccccagactccacgaattgcacctgacacatgacacctcttaagagggcaacgaggaaaacccagctcagcccaaacccttcgatcgcgtctaaatcgagcaccggtcgtgtatatactgtctgatggcgcgagggaggcgatacg

SEQ ID NO: 790968 - DNA, 605 bp, Homo sapiens
  misc_feature: 21442.UNK.UNK.UNK.pb.heavy.1.raw 21442
ccgacacgcttgctagggacttggagctaaggacgacatattgcctttagacagtcgaaggtgacgccttagctaccactgaacgtttaggcgccagatgcggtctggatgacctaactcgcagcttatcgatgatctactgcacgctcaaccaaccaggtcttgatgcgcgcgataggactgacgggatcgctacagacatttaactcgctagtaacttaattgagatccttagggggatgggataggaaatagaatccacccctatcaccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagatggcgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 790969 - DNA, 703 bp, Homo sapiens
  misc_feature: 21453.44.27.C05.1.pb.heavy.1.raw 21453
ctatgcgccttgccagcccgctcagacagtatataggaagtagtccttgaccaggcagcccagggccgctgtgctctcggaggtgctcctggagcagggcgccaggggaagaccgatgggcccttggtggaggccgaggagacggtgaccagggttcccctggccccaggcgtcgaatgaaccgattttggaaacagatagtctcgcacaaaaatacacggcgtgtcctgaggtctcaggctgtttcatttgaagagacactgtgttctcggaattgtctctggagatggtgaatcggccctcaacggaatcacccgtagacttgatttcctccatgaaatgacacacctgccacccactccagccctcgcctggagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagcccaaacccttcgatcgcgtctaaatcgagcaccggtcgtgatagtatagactgatggcgcgagggaggcgatacg

SEQ ID NO: 790970 - DNA, 704 bp, Homo sapiens
  misc_feature: 21456.44.56.F01.1.pb.heavy.1.raw 21456
cgtatcgcctcctcgcgccatcagacagtattatacacgaccggtgctcgatttagcagacgtctgaacacacaaaggggctggagaggagccccagccgtgagattcccaggagtttccacttggtgatcagcactgagcacagaccaccaaccatggagtttggctaacttgattttcctgtagtttttttagaaaggtgtccagtgcgagggcgactggcggagtcgggggggggcttggcacagccagggcggtctctgagactctcctgtgtagtctcaggattcagtcttagtgattatcacttggcctgggtccgtcaggctccagggaagggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccagggacaatggtcaccgtctcttcagcttccaccaagggccatcggtcttccccctggcgccctgctccagagcacctctggggggcacagcggccctgggctgcctggtcaaggactacttcctatatactgtctgagcgggctggcaaggcgcatag

SEQ ID NO: 790971 - DNA, 663 bp, Homo sapiens
  misc_feature: 21459.UNK.UNK.UNK.pb.heavy.1.raw 21459
ctatgcgccttgcagcccgctcagacagtatatagaagtagtccttgacaggcagcccaggccgctgtgctctcggaggtgctcctggagcaggcgccaggggaagaccgatgggcctggtggaggctgagagacggtgaccagggttccctggcccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccacgtcagctttggttctaatacgccaacccactccagccccttccctggagcctggcgggacccaggtcatccaggcgttactgaagtgaatccagaggctgcacaggagagtctaagggactcccagggctttaccaacctcccccagactccacaactgcactcacactggacaccttttaaaatagcagcaaggaaaatccagctcagccaaactccatggtgagtctctgtgttcagtcctgatcactgaatgaaaacactgggatcccaaggctgggctcctctcccagagctcaaccactctctctaatcgagcacccggtcgtgtatatactgtctgatggcgcgagggaggcgatacg

SEQ ID NO: 790972 - DNA, 649 bp, Homo sapiens
  misc_feature: 21496.44.23.C01.1.pb.heavy.1.raw 21496
ctatgcgccttgccagcccgctcagacagtatataggaagtagtccttgaccaggcagcccagggcgctgtgccccagaggtgctcctggagcagggcgccagggggaagaccgatgggccttggtggaagctgaggagacagtgaccagggtggccacggccccattagattgaaagaccagtctcgcctcgcacagaaataaacggccgtgtccgcggcggtcacggaggtcagtttcaggggagaagcggttcatggacgtgtccctcgaaatggtgagacgactctgagggacggagagtagtacgtcgccccagtataatggatgtcaccaatccactccattcccctcctgggggctgccggatccagcccaagaatgatcagaactgatggaaactccagagacagtgcagatgagagacgggttcccgaaggcctcaccagtcctgggcccgactcctgcagctgcacctgggacaggacccatctgggagctgccaccagcaggaggaaaaccacaggtgcttcatgttcttgcacaggaggtccttgactctcagaaagcccccaatccctaatcacgtgtactaaatcgagcaccggtcgtgtatatactgtctgatggcggcgagggaggcgatacg

SEQ ID NO: 790973 - DNA, 710 bp, Homo sapiens
  misc_feature: 21545.UNK.UNK.UNK.pb.heavy.1.raw 21545
ctatgccgccttgccagcccgctcagacagtatataggaagtagtccttgaccaggcagcccagggccgctgtgctctcggaggtgctcctggagcaggggcgccagggggagaccgatgggcccttggtggaggctgaggagacggtgaccagggtttccctggccccagtggacagtttcctgatataaacacaacaacaataatacatgcccgtgtcctcggtttttcaggttagtcattcgcagaatcaatgagttcttgaagtcatctcttgagagggtgaatctggctttcacagacgcggcgtactctgtgataaagctggcaactttgttttttactgcggccaagccactccagcccctttccctggagcctggcggacccagtccatatagtggtcactgatggtgaatccagaggcgacacaggagaagtctcagggaccctccaggctggaccaagtctccccggactccaccaactgcacttcactctggacaccttgtaaaaataacaacaaggaaaaaacccagctcagcccgaaactccatggtgagtcctctgtgttcagtgctgatcaccaaatgaaaacacctgggaatctggggctggggctccgctctcccccaagagagatcgtgacgcagctaaatcgagccaccggtcgtgtatatactgtctgatggcgcgagggaggcgatacg

SEQ ID NO: 790974 - DNA, 692 bp, Homo sapiens
  misc_feature: 21573.44.74.G08.1.pb.heavy.1.raw 21573
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggtgacaatgaccagggttccctgccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaagagggatgattccacccatccactcaagcccttgtccaggggcctggcgcacccagttgatggtataagtagtggaactggtagtacttccagaggccgtgcaggaaagggtcaccgaggaccaaggttgcggcattctagtcccagactgcaccagttgcaccagggactggacacctgttgctgctgccaccacaaagaggaacctccaggtccagtccatggtgatgagctgtgctcccaggggcttctttagaggaggaatgtggttgttatgtgatgctccccctgatagagctactaaatcgagcaccggtcgtgtatatactgtctgatggcgcgagggaggcgatacg

SEQ ID NO: 790975 - DNA, 650 bp, Homo sapiens
  misc_feature: 21579.UNK.UNK.UNK.pb.heavy.1.raw 21579
ctattgcgccttgccagccgctcagacagtatataggaagtagtccttgaccaggcagcccaggccgctgtgcccccagaggtgctcctggagcaggggcgccaggggaagaccgatgggccctttggtggaagctgaggagaccagtggacccaggtgccacggcccccatagattgaaagaccagtctccgcccgccacagaaataaacggccgtgtccgcggcggtcacgaggtcagtttccagggagaagcggttcatgacgtgttccctcgagaatggtgagacgaactcttgagggacggagagtagtacgtcgccccagttaatggatgtcaccaatccactccattccctccctgggggggctgccagccccaagaatgatcagaactgatggaaactccagagacagtgcagatgagagacaggttcccgaaggcctcaccagtcctggcccgatcctgcagctgcacctggacaggacccatctgggagctgccaccagcaggagggaaaaaccacaggtgctcatgttcttgcacaggagccttgactctcagaaaagcatcccccaaaccaagtctatagcactaaatcgagcaccgtcgtgtatatactgtctgatggccgcgagggaggcgatacg

SEQ ID NO: 790976 - DNA, 697 bp, Homo sapiens
  misc_feature: 21592.44.27.C05.1.pb.heavy.1.raw 21592
cgtatcgcctccctcgcgccatcagacagttatacacgaccggtgctcgatttagacgcgatcgaagggtttggggagccctggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctggggaggcgtggcccagtaggggggtccctgagactctcctgtgcagcctctggattcaccttcgataattggaatatgcagtgggtccgccaggctccaggcgagggctggagtgggtggcaggtgtgtcatttcatggaggaaatcaagtctacggtgattccgttgagggcgattcaccatctccagagacaattccgagaacacagtgtctcttcaaatgaacagcctgagacctcaggacacggccgtgtatttttgtgcgagactatctgtttccaaaatcggttcattcgacgcctggccagggaaccctgtcaccgtctcctcgcctccaccaagggcccatcggtcttccccctggcgccctgctccaggagcacctccgagagcacagcggccctggctgcctggtcgaggactacttcctatatactgtctgagcgggctggcaaggcgcatag

SEQ ID NO: 790977 - DNA, 732 bp, Homo sapiens
  misc_feature: 21595.44.86.H09.1.pb.heavy.1.raw 21595
cgtatcgcctccctcgcgccatcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtcccagtgtcaggtgaagctggtggagtctgggggaggcgtggtcccagcctgggaggtccttgagactctcctgtgtagcgtctggattcccttcaacagaccatggcatgcactgggtccgccaggctccaggcaagggactgagtgggtggcacttatatggtatgatggaagtaataaatattatgtagattccgtgaaggggccgattcaccatctccagagacaattcgaagaacacactatatctggaaatgaatagcctgagagccgaggacacggctgtctactactgtgcgagagatggggctcgtggatacagatatgacatgctcttactccaatggtatggacgcctggggccaagggacacggtcgccgtctcctcagcctccaccaagggccccatcggtcttccccctggcaccctcctccaagagcacctctgggggcacagcggccctgggctgcctggtcaaggactacttcctatatactgtctgagcgggctggcaaggcgcatag

SEQ ID NO: 790978 - DNA, 714 bp, Homo sapiens
  misc_feature: 21609.UNK.UNK.UNK.pb.heavy.1.raw 21609
ctatgcgcgccttgccagcccgctcagacgactatataggaagcgtagtccggttgaccagcagcccagggccgctgtgccccagaggtgctcctggagcagggccgccagggggaagaccgatgggccttggggaagctgagggtgacaatgaccagggttccctgccccccagatctcaaaggctcccatgccgagctggggtacggacccctcctcgcacagtagtagacggccgtgtcgtcggatttcaaaagaactcattgtcatggagactggtgtctgtggacttgtccgccgcgcggtaatccgtaattctgcccggaagtctcgtggcgtaggtgagtgagccaaaaagagggatgattccaccatccactcaagcccttgtcccagggggcctgggcgcacccagttgatggtataagtagtggaactggtagtacttccagaggccgtgcaggaaagggtcacccgaggacaaggttgcgggcattctagtcccagactggcaccagttgcaccagggactggaccacctgttgctgctgccaccaccaaaagaggaacctccagcggtccgtcccatgtgatgagctgtgctcccaggggctttcttttagaggaggaggaatgtggtttgtcagtagatctaaatcgagcacgggtccgtggatataccctgtctgatgcgcgccgagggagggcgatacg

SEQ ID NO: 790979 - DNA, 606 bp, Homo sapiens
  misc_feature: 21620.UNK.UNK.UNK.pb.heavy.1.raw 21620
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggaccctagtggccaagatggccgctagcgggttccgcagcttttgacctggaccagggtgcatagcctgcccagccttc

SEQ ID NO: 790980 - DNA, 543 bp, Homo sapiens
  misc_feature: 21625.44.38.D05.1.pb.heavy.1.raw 21625
cgtatcgcctccctcgcgccatcagacagtatatacacgaccggtgctcgatttagtatctgatagttcagcctggggggtccctgagactctcctgtgcagcctctggattcaccttcagtagctactgatgcactggtccgccaagctccaggggaaggggctggtgtggggtctcacgtattaatagtgatgggagtagcacaagctacgcggactccgtgaagggccgattcaccatctccagagacaacgccaagaacacgctgtatctgcaaatgaacagtctgagagccgaggacacgctgtgtattactgtgcaagagccggtgcgggagttcgggagttgcatactactactacggtatggacgtctggggccaagggaccacgggtcaccgtctcctcagcttccaccaagggcccatcgccttccccctggcgcccttgctccaggagcacctctgggggcacagcggccctgggctgcctggtcaagactacttcctatatactgtctgagcgggctggcaaggcgcatag

SEQ ID NO: 790981 - DNA, 677 bp, Homo sapiens
  misc_feature: 21641.44.45.E01.1.pb.heavy.1.raw 21641
cgtatcgcctccctcgcgccatcagacgtatatacacgaccggtgctcgatttagtgagtcagtaagggaaaggggctgggagaggagccagcactagaagtcggcggtgtttccattcggtgatcagcactgaacacagaggactcaccatggagtttgggctgagctggttttcctcgttgctcttttaagaggtgtccagtgtcaggttcagctggtggagtctggggaagggcgtgggtccagcctgggacgtccctgagactctcctgtgtgcgtcccggactcagtttcagtgactctgccatgcactgggtccgcaggctccaggcaaggggctggagtgggtggcagtcatctggtctgatggaagtaaagaatactatggaaactccgtgaagggccgattctccgtctccagagacaattccaagaacaccgtgtatctacaaatgaacaattgagagccgaggactcgctctctattattgtacgagcccatcgttctactggggccagggagcctggtcaccgtctcctcagcctccaccaagggccatcggtcttccccctggcgccctgctccaggagcacctccgagagcacagcggccctgggctgcctggtcaaggactacttcctatatactgtctgagcgggctggcaaggcgcatag

SEQ ID NO: 790982 - DNA, 677 bp, Homo sapiens
  misc_feature: 21642.44.45.E01.1.pb.heavy.1.raw 21642
cgtatcgcctcctcgcgccatcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctgggggaggcgtggtccagcctgggacgtccctgagactctcctgtgttgcgtccggactcagtttcagtgactctgccatgcactgggtccgccaggctccaggcaagggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgca

SEQ ID NO: 790983 - DNA, 625 bp, Homo sapiens
  misc_feature: 21676.UNK.UNK.UNK.pb.heavy.1.raw 21676
cgtatgcgcctcccctccgcggcatccagacgtatatcacgacccggtgctcgatttagctgcgtcacgatctctcctgggtcttgtcccaggtcacctgaaggagtcctggtcctgtgctgggaaacccacagaagaccctcaccgcctgacctgcaccatctctggggttctctctcaacgatattagaatgggtggtgagctggatccgtcagccccccccaggaagggccctggagtggcttgcacacatccttctcgaatgacgaaaatcccgacagtacatctctgaagagcagtttaaccatctccaaggacacctccaaaaggccaggtggtctttagtatgaccaacatggaccctgcggaccacaggcacatattactgtgcacgggtaatgccgggaagaaacgcctgtttctgtattataagtcttaccatctggacgtctggggcaaagggacccaccggtcaccgtctcctcagccttccaccaagggcccatccggtcttccgcctggggcccctgctccaggagcacctctggggggcacagcggccctgggctgcctggtcaaggactacttcctatatactgtctgagcgggctgcaaggcgcatag

SEQ ID NO: 790984 - DNA, 688 bp, Homo sapiens
  misc_feature: 21685.UNK.UNK.UNK.pb.heavy.1.raw 21685
ctatgcgccttgccagccgctcagacagtatataggaagtagtccttgaccaggcagcccagggccgctgtgccccagaggtgctcttggaggagggtgccagggggaagacgatgggcccttggtggaggcgaggcgacggtgaccagggttccctgccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcgcccttcacgagtctgcgtagtatgtgaaatcaccagtataaatgactgagacccactccagccccttccctggagcctggcggacccaactcatgtagttgctgctgacggtgagccagaggctgcacaggagagtctctggacccccaggctggactaagcctcctccagactccatcagccgcacctcacactggacaccttttaaaagtccaacaaggagaacccagctcagccaaactccatggtgagtcctctgtgttcagtgctgatcaccgaatggaaacactcggaatcccagtgctgggctcctctcccaaacccaacgtgcgagtgctaaatcgagcaccgtcgtgtatatactgtctgatggcgcgaggaggcgatacg

SEQ ID NO: 790985 - DNA, 680 bp, Homo sapiens
  misc_feature: 21739.UNK.UNK.UNK.pb.heavy.1.raw 21739
ctatgcgcccttgccagctccgctcagacagctatataggaagtagtccttgaccaggcagcccaggccgcgctgtgccccccagaggtgctcttggaggagggtgccaggggaaagaccgatgggccttggtggaggctgaggagacgggaccagggttccctgccccagtggtcaaagtagttggggtgacgaactggcctactctcgcacagtaatacacggccgtgtccgcggcggtcacagagctcagccttcagggagaactgggttcttggacgtgtctactgatatggtgactcccgactcttgagggacgggttgtagtaggtgctcccactataatagatactcccaatccactccagccccttccctggggctggcgatccagccccagtagtaacctactactgctgatggagccaccagagacaggtggcaggtgaggggacagggtctccgaaaggcttcaccagtcctgggcccgactccctgcagctgcagctggggacaggacccatctgggagccccgcccaccagcaggaggaagaaccacaggtgcttcatgttcttgcacaggaggtccatgactctcagaaagcccccgcggaatctacactactaaatcgagcaccgtcgtgtatatactgtctgatggcgcgagggaggcgatacg

SEQ ID NO: 790986 - DNA, 606 bp, Homo sapiens
  misc_feature: 21770.UNK.UNK.UNK.pb.heavy.1.raw 21770
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatcttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 790987 - DNA, 664 bp, Homo sapiens
  misc_feature: 21771.44.29.C07.1.pb.heavy.1.raw 21771
gtatcgcctccctcgcgccatcagtctatactatcacgaccggtgctcgatttagagtgctacgaagggaaagggggaaactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcagggtgatggagcgattggtgggctgggtccgtcagcccccaggaaaggcctggagtggcttgcactcatttattgggatgatgataggcgctacagtccatctctgaagagcagactctccatcaccggagacgcctccaatacgcaggtgatccttagagtggccaacatgggcctgcggacacagccacatactactgcgcacacatgatcaactattataaaagtggtgggttatgtgagtggcttggatatctggggccaagggaacaatggtcaccgtctcttcagcctccaccaagggcccatcggtcttccccctggcgccctgctccaggagcacctccgagaagcacagcggccctggctgcctggtcaaggactacttcctatatactgtctgagcgggctggcaggcgcatag

SEQ ID NO: 790988 - DNA, 709 bp, Homo sapiens
  misc_feature: 21849.UNK.UNK.UNK.pb.heavy.1.raw 21849
cgtatcgcctccctcgcgccatcagacagtatatacacgaccggtgctcgatttagcagacgtcctgaacacacaaaggggctgggagaggagccccagccgtgagattcccaggagtttccacttggtgatcagcactgagcacagaccaccaaccatggagtttgggctaatcttgattttccttgtagtttttttagaaggtgtccagtgcgagggcgactggcggagtcgggggggggcttggcacagccagggcggtctctgagactctcctgtgtagtctcaggattcagtcttagtgattatcacttggcctgggtccgtcaggctccagggaagggcttgagtggatcactttcgtcagaatgaaacgttatggtggaagtaaagagtacgccgcgtctgtgaagggaagattcaccgtctcaagggatgactccaacagtgttggccatttacaaatgaagcaacctgagacccgacgacacaggcgtctattactgcgccaggcgatcctgggacgtcgatgcatttgatatttggggccaggggacaatggtcaccgtctcttcagcttccaccaagggcccatcggtcttcccctggcgccctgctccaggagcacctctggggcacagcggccctgggctgcctggtcaaggactacttcctatatactgtctgagcgggctggcaaggcgcatag

SEQ ID NO: 790989 - DNA, 652 bp, Homo sapiens
  misc_feature: 21864.44.70.G04.1.pb.heavy.1.raw 21864
cgtatcgcctccctcgcgccatcagacagtatatacacgaccggtgctcgatttagtgtagtgtgaagggaaagggggactcctgtgccccaccatggacacactttgctccacgctcctgctgctgaccatcccttcatggggcctgtccagatcaccgtgaaagagtctggccctacattggtgaaacccacacagaccctcacgctgacctgcaccgtctcaggcttctcactcgtcactcctggagagggcgttgtctgggtgcggcagccccccggaaagggccctggagtggatcgcactcacttattggaatgacgaatatacgatatagtccttctctgacgaccagactcacgctcacgaaaggacacgtccaaaaccaggtggtccttacattgaccaacgtggaccctgtggacacaggcacatatttctgtgcccacttcatgaccacaatgaccacgggcttcttcgaaccctggggccagggaatccaggtcaccggtctcatcagcctccaccaagggccccatcggtcttccccctggccgcctgctccaggagcacctcgagagcacagcggccctgggctgctggtcaaggactacttcctatatactgtctgagcgggctggcaagcgcatag

SEQ ID NO: 790990 - DNA, 680 bp, Homo sapiens
  misc_feature: 21885.UNK.UNK.UNK.pb.heavy.1.raw 21885
ctatgccgcctggccagcccgcttcagacagtatataggaagtagtccttgaccataggcagcccagggccctgtgcccccagaggtgctcttgaggagggtgccagggggaagaccgatgggcccttggtgggagggctgaggagacggtgaccagggttccctggcccagtggtcaaagtagttggttggacgaaactgccctactctcgcacaagtaatacacacccgttggtccgcggcggtcacagagctcaggcttcaggaggaactggttcttggacgtgtctactgatatggtgacttcgactcttgagggacgggttgtagtaggtgctccccactataatagatactcccaatccactccagccccttccctgggggctggcggatccagccccagtagtaactactacgctgatggagccaccagagacagtgcaggtgagggacagggtctccgaaggcttcaccagtcctgggcccgactcctgccagctgcagctgggacaggaccatctgggagccggccaccagcaggaggaagaaccacagtgcttcaaagttcttgcacaggagtccatgactctcagaaaaagcccccgcggaatctacactactaaatcgagcactcggtgtgatatatactgtctgatggcggcgaggagcccgatacg

SEQ ID NO: 790991 - DNA, 682 bp, Homo sapiens
  misc_feature: 21896.44.45.E01.1.pb.heavy.1.raw 21896
cgtatcgcctccctcgcgccatcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctggggaggcgtggtccagcctgggacgtccctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 790992 - DNA, 703 bp, Homo sapiens
  misc_feature: 21919.44.73.G07.1.pb.heavy.1.raw 21919
cgtatcgcctccctcgcgccatcagacagtatatacacgaccggtgctcgatttagctctacgctcagggagctctgggagaggagcccagcactagaagtcggcggtgtttccattcggtgatcagcactgaacacagaggacttcaccatggagtttgggctgagctgggttttcctcgttactcttttaagaggtgtccagtgtcaggtgcacctggtggagtctgggggaggcgtggtccagcctgggaggtccctgagactctcctgtgaagcctctggatttagtttcagtagttctggcatgcactgggtccgccaggctccaggcaaggggccggagtggttggcagttatagcaatatgatggaacttctagatattatgcagactccgtgaagggccgattcaccatctccagagacaattcccggaacactctgtacctggaaatgatcagcctgagaggcgaggactcggctctgtattactgtgcgagatcgggaagtggcagcagctattatcggcgtttcactgggccaggggacactggtcaccgtctcctcagcctccaccaagggcccatcggtcttccccctggcgccctgctccaggagcacctccgagagcacagcggccctgggctgcctggtcaaggactacttcctatatactgtctgagcggctggcaaggcgcatag

SEQ ID NO: 790993 - DNA, 609 bp, Homo sapiens
  misc_feature: 21928.UNK.UNK.UNK.pb.heavy.1.raw 21928
ctatgcgccttgccagcccgctcagacaggtatataggaagtagtccttgaccaggcagcccagggccgctgtgctctcggaggtgctcctggagcaggcgcagggggaagaccgatgggcccttgtggaggccgaggagacggtgaccagggttccctggccccaggcgtcgaatgaaccgatttggaaacagatagtctcgcacaaaatacacggccgtgtcctgagtctcaggctgttcatttgaagagacctgtgttctcggaattgtctctggagatggtgaatcggccctcacggaatcaccccggtagacttgatttccccatgaaatgacacacctgccacccactccagcccctcgcctggagcctggcggaccccactgcatatccaatatcgaaggtgaatccagaggctgcacaggagaagtctcagggacccccctactggggccacgcctcccccagactccacgaattgcacctgacacatgacacctcttaagaggccaacgaggaaaccagctcagcccaaacccttcgatcgcgtctaaatcgagcaccgtcgtgtatatactgtctgatggcgcgaggggaggcgatacg

SEQ ID NO: 790994 - DNA, 704 bp, Homo sapiens
  misc_feature: 21939.UNK.UNK.UNK.pb.heavy.1.raw 21939
ctatgcgccttgccagcccgctcgacagtatataggaagtagtccttgaccagggcagcccagggccgctgtgctctcggaggtgctcctggagcagggcgccagggggaagaccgatgggcccttggtggaggccgaggagacggtgaccaggttccctggccccaggcgtcgaatgaaccgattttggaaacagatagtctcgcacaaaaatacacggccgtgtcctgaggtctcaggctgttcatttgaagagacactgtgttctcgaattgtctctggagatggtgaatcggcctcaacggaatcaccgtagacttgatttcctccatgaaatgacacacctgccacccactccagcccctcgcctggagcctggcggaccactgcatattccaattatcgaaggtgaatccagaggctgcacaggagagtctcagggacccccctactggggccacgcctcccccagactccacgaattgcacctgacacatgacacctcttaagagggcaacgaggaaaacccaggctcaggcccaaactccatggtgagtcctctgtgttcagtgatgatcaccgagtggaaacaccggcgaacttccagtgctgggctcgtctcccagccccaaacccttcgatcgcgtctaaatcggagcaccggtcgtgtatatactgtctgatggcgcgagggaggcgatacg

SEQ ID NO: 790995 - DNA, 681 bp, Homo sapiens
  misc_feature: 21947.44.73.G07.1.pb.heavy.1.raw 21947
ctatgcgccttgccagcccgctcagacagtatataggaagtagtccttgaccaggcagcccagggccgctgtgctctcggaggtgctcctggagcaggcgccaggggaagaccgatgggcccttggtggaggctgaggagacggtgaccagggttccctggccccagtagtcaagcggggaccgtctcgagggggctctcgcacaataatagacagccgtgtcctcacttgtgaggttgtacatttgcagatgcagtgtgtcctggaattgtctctggagacggtgaatcggcccttctcggagtctccgtagtgttcttcaattccatcttctgatataattgccacccactccagcccttgcctggagcctggcggacccagtgcatggcataggtcctgaagatgaatccagaggctgcacaggagagtctcagggagttcccaggctggccgctcctcccccagactccactagctgcacctgacactggccacctcttaaagagcaacgaggaaaacccatctcagcccaaagtccatgtgagtcctctgtgttcagtgatgatcacgaatggaaacaccggcgacttcagtgctgggctcgtctcccccctgagcgtagagctaatcgagcaccggtcgtgtatatactgtctgatggcgcgaggaggcgatacg

SEQ ID NO: 790996 - DNA, 679 bp, Homo sapiens
  misc_feature: 21948.44.74.G08.1.pb.heavy.1.raw 21948
cgtatcgcctccctcgcgccatcagacagtatacacgaccggtgctcgatttagtagctctatcagggggagcatcacatacaaccacattcctcctctaaagaagcccctgggagccagctcatcaccatggactggaccctggaggttctcttgtggtggcagcagcaacaggtgtccagtcctggtgcaaactggtgcgtctgggactagaatgccgcaaccttggtctcggtgaccctttcctgcacggcctctggaagtactaccagttccactattataccatccaactggggcgccaggccccctggacaaggcttgagtggatgggtggaatcatccctctttttggctcactcacctacgcacgagacttccgggcagaattacgattaccggcggacaagtccacagacacagtctccatgacaatgagttctttgaaatccgacgacacggccgtctactactgtgcgagaggtccgtacccagctcgcatggagcctttgagatctgggggcaggaaccctggtcattgtcacctcagcttccaccaagggcccatcggtcttcccctggcgccctgctccaggagcacctctggggcacagcggccctggctgcctggtcaaggactacttcctatatactgtctgagcgggctggcagggcatag

SEQ ID NO: 790997 - DNA, 661 bp, Homo sapiens
  misc_feature: 21962.44.35.D02.1.pb.heavy.1.raw 21962
cgtatcgcctccctcgcgccatcagacagtatatacacgaccggtgctcgatttagcacacgatagttgggttggggatactttctgagactcatgggcctcctgcacagaacatgaaacacctgtggttcttcctcctcctggtggcacctcccagatgggtcgtgtccgagtgcagctgcaggagtcgggccaggacgggtgaagccttcggagaccctgtccctcacctgcaatgtctctggtggttacatcagtagttattattggagttggctgcggcagtccgccggaagggactgagtggattgggcgcatctataacagtggcagcacaactacaacccgccccctcaagagtcgagtcaccatgtcactagacaggtccaagaaccagttctccctgaattgactctgtgaccgccgcggacacggccgtatattattgtgcgagagattcctatcgatacagtagagacgggggcgaactggctcgacccctggggccaggaaccctggtcaccgtctcctcagcctccaccaagggccatcggtcttccccctggcacctcctccagagcacctctggggcacagcgccctggctgcctggtcaaggactacttctatatactgtctgagcgggctggcaaggcgcatag

SEQ ID NO: 790998 - DNA, 599 bp, Homo sapiens
  misc_feature: 21985.44.78.H01.1.pb.heavy.1.raw 21985
cttatgcgccttgccagccccgctcagacagtatataggaagtagtccttgacccaggcaagcccagggccgctgtgctctcggaggtgcctcctggagcagggcgcccaggggaagaccgatgggcccttggtggaggctgaggagacgggtgaccagggttccctggccccacaagtcaagccaggtgctggtggctctcgcacagaaatacacggccgtgtcctcagatctcaggctgcttcagttccatgtagactgtacctgggaggtgctcctggtcatactaactctgccttggaacttctgggcaaagcccgtggttgccactatagggcttcatccatccatccactccagccttgtccagcggcctgtcgcacccagttaatatcataattgatgaacgttgtatccagaagccgtgcaggagactgtcactgaggccccaggcttcttcacctcagccccagactgcaccagcttgtacctgggagtgggaccgtcagtcttctcttccccccaaacccaaactactcacactaaatcgagcaccggtcgtgtatatactgtctgatggcgcgagggaggcgattacg

SEQ ID NO: 790999 - DNA, 592 bp, Homo sapiens
  misc_feature: 21990.UNK.UNK.UNK.pb.heavy.1.raw 21990
cgtatcgcctccctcgcgccatcagacagtatatacacggaccggtgctcgatttagtgtgagtagtttgggtttgggggaagaggaagactgacggtccactcccaggtacagctggtgcagtctggggctgaggtgaagaagcctgggcctcagtgacagtctcctgcacggcttctggatacaccgttcatcaattatgatattaactgggtgcgacaggccgctggacaagggctggagtggatgggatggatgaagccctatagtggcaacacgggctttgcccagaagtccaaggcagagttagtatgaccaggagcacctccccaggtacagtctacatggaactggagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggacttacttcctatatactttctgagcgggctggcaaggcgcatag

SEQ ID NO: 791000 - DNA, 649 bp, Homo sapiens
  misc_feature: 22007.44.23.C01.1.pb.heavy.1.raw 22007
cgtatcgcctccctcgcgccatcagacagtatatacacgaccggtgctcgatttagtacacgtgattagggattgggggctttctgagagtcaaggacctcctgtgcaagaacatgaagcacctgtggttttcctcctgctggtggcagctcccagatgggtcctgtccaggtgcagctgcaggagtcgggcccaggactggtgaggccttcgggaaccctgtctctcatctgcactgtctctggagtttccatcagtttctgatcattcttggggctggatccggcagccccccagggagggaatggagtggattggtgacatccattatactggggcgacgtactactctccgtccctcaagagtcgtctcaccatttcgagggacacgtccatgaaccgcttctcctgaaactgacctccgtgaccgccgcggacacggccgtttatttctgtgcgaggcgagactggtctttcaatctatggggccgtggcaccctggtcactgtctcctcagcttccaccaagggcccatcggtcttcccctggcgccctgctccaggagcacctctggggcacagcggccctgggctgcctggtcaaggactacttcctatatactgtctgagcgggctggcaaggcgcatag

SEQ ID NO: 791001 - DNA, 725 bp, Homo sapiens
  misc_feature: 22017.UNK.UNK.UNK.pb.heavy.1.raw 22017
cgtatcgcgcctccctcggcgcatcagacagtatatacacgaccgggtgctcgatttagaccgcgatcgaagggtttggggcctgggagacgagcccagcactggaagtcgccgcggtgtttccactccgagtgatcattcactgaacacagaggagctcaccatggagtttgggctgagctgggttttcctcgttgccctcttaagggtgtcatgtgtcaggtgcaattcgtggagtctgggggggaggcgtggcccagtagggggggggtccctgagactctcctgtgcagcctctggattcaccttcgataattggaatatgcagtgggtccgccaggctccagggcgaggggcggaggctgagtggggtggcaggtgtgtcatttcatggaggaaatcaagtctacggtgattccgttgagggccgattcaccatctccagagacaattcccgagacacaggtgtctcttcaaatgaacagcctgagacctcaggacacggccgtgtatttttgtgcgagactatctgtttccaaaatcggttcattcgacgcctggggccagggaaccctggtcaccgtctcctcggcctccaccaaggcccatcggtcttcccctggcggccctgctccaggagcacctccgagagcacagcggccctgggctgcctggtcaaggactacttcctatatactgtctgagcgggctggcaaggcgcatag

SEQ ID NO: 791002 - DNA, 644 bp, Homo sapiens
  misc_feature: 22021.UNK.UNK.UNK.pb.heavy.1.raw 22021
cgtatcgcctccctcgcgccatcagacagttatatacacgaccgtgctcgatttagtgagtcagtaaggggactcctgtgccccaccatggacacactttgctccacgccctgcctgctgaccatcccttcatggggcctgtcccagatcaccgtgaaagagtctggcctacattggtgaaaccacacagaccctcacgctgacctgcaccgtctcaggcttctcactcgtcactcctggagagggcgttgtctggggtggcggcagccccccggaaaggccctggagtgatcgcactcacttattggaatgacgatatacgaatagtccttcctctgacgaccagactcacgctcacgaaggacacgtccaaaaacaggtggtccttacattgaccaacgtggaccctgtggacacaggcacatatttctgtgcccacttcatggaccacaatgaccacgggcttcttcgaaccctggggccagggaatccaggtcaccgtctcatcagcctccaccaaggggcccatcggtcttccccctggcgccctgctccaggagcacctccgagagcacagcggcctgggctgcctgtcgaaggactacttcctatatactgtctgagcgggctggcaaggcgcatag

SEQ ID NO: 791003 - DNA, 698 bp, Homo sapiens
  misc_feature: 22036.UNK.UNK.UNK.pb.heavy.1.raw 22036
cgtatcgcctcctcggcgcgcatcagacagtattaccacgaccggtgccgattctagcactcgcactgttgggtttcggcggggagaggagcccagcactggattccgacggtgtttccattggtgatcagcactgaacacaggggactcaccatggagttttggctgagctggttctccttgttggacttttaaaaggtgtccagtgtgagtgcggctgatggagttggaggaggcttagtcccagcctggggggtcccagagactctcctgtgcagcctctggctcacgtcgcagcaactacatgattgggtccgccaggctcagggaaggggctggagtggtctcatcatttaactggtgatttcacatactacgcagactccgtgaagggccgattcaccatctccagggacaatccaggaacccggtttatcttcaaatgaacaacctgagaagcgacgacacggccgtctattactgtgcgagacaaagtcgggcgctcggagtggtattattcgtttgacttctggggccaggaaccctggtcaccgttcgcctccgcctccacaagggccatcgcctcttcccctggcacccctcctccaagagcacctctgggggcacagcggttctgggctgcctgggtcaaggatactcctatatactggtctgcagcgggctggcaaggcgcatag

SEQ ID NO: 791004 - DNA, 687 bp, Homo sapiens
  misc_feature: 22048.44.36.D03.1.pb.heavy.1.raw 22048
cgtatcgcctccctcgcgccatcagacagttatacacgaccggtgctcgattagctgcgtcacgatctctcttggggagctctgagagcggagccccgccccagaattcccaggtgttttcatttggtgatcagcactgaacacagaggactcaccatggagttcgggctgagctgggtttccttgttgttatttacaggtgtccagagtgaagtgcagtggtggagtccggggagacttggtccagcctggagggtccctgagactctcctgtgtcgcctctggattcaccatcagtgaccactatatggactggtccgccaggctccagggaaggggctggagtggcttggccgcagtaaaacaaagtgccagctttatcacagagtacgccgcgtctgtgaaagccagattcaccctctcaagagatgactcaagaactcattgattctgcgatgactaacctgaaaccgaggacacgggcatgtattattgtgttgtgttatatcaggaactgtccactggggccaggaaccctggtcaccgtctcctcagcctccaccaagggccctcggtcttcccctggcgccctgctccaggagcacctccgagagcacagcggccctgggctgcctggtcaaggactacttcctatatactgtctgagcgggctggcaaggcgcatag

SEQ ID NO: 791005 - DNA, 618 bp, Homo sapiens
  misc_feature: 22050.44.38.D05.1.pb.heavy.1.raw 22050
cgtatcgcctccctcgcgccatcagacagtatatacacgaccggtgctcgatttagtatctgatagctgggtttttccttgttgctattttaaaaggtgtccagtgtgaggtgcagctgtggagtccgggggaggcttagttcagcctgggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaaggggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctgggccaaggggaccacggtcaccgtctcctcagcttccacaagggcccatcggtcttcccctggcgccctgctccaggagcacctctgggggcacagcggccctgggctgcctggtcaaggactacttcctatatactgtctggagcgggctggcaaggcgcatag

SEQ ID NO: 791006 - DNA, 670 bp, Homo sapiens
  misc_feature: 22064.44.35.D02.1.pb.heavy.1.raw 22064
cgtatcgcctcctcgcgccatcagacagtatatacacgaccggtgctcgatttagcacacgatagtgggtttggggatactttctgagactcatgggcctcctgcacaagaacatgaaacacctgtggttcttcctcctcctggtggcacctcccagatgggtcgtgtccgaggtgcagctgcagagtcgggccaggacgggtgaagccttcggagaccctgtccctcacctgcaatgtctctggtggttacatcagtagttattattggagttggctgcggcagtccgccggaagggactggagtggattgggcgcatctataacagtggcagcaccaactacaaccccgccctcaagagtcgagtcaccatgtcactagacaggtccaagaaccagttctccctgaaattgacttctgtgaccgcgcggaacggccggtatattattgtgcgagagattcctatcgatacagtagagacgggggggcgactggctcgaccctggggccagggaacccctggtcaccgtctcctcagcctccaccaaggcccatcggtcttcccccctggcaccctcctccaagagcacctctggggcacagcggcctgggctgcctggtcaaggactacttcctatatactgtctgagcgggctggcaaggcgcatag

SEQ ID NO: 791007 - DNA, 620 bp, Homo sapiens
  misc_feature: 22069.44.23.C01.1.pb.heavy.1.raw 22069
tgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagcccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgttcaccctgcccccaatccctaatcacgtgtactaaatcgagcaccggtcgtgtatatactgtctgatggcgcgagggaggcgatacg

SEQ ID NO: 791008 - DNA, 702 bp, Homo sapiens
  misc_feature: 22071.44.67.G01.1.pb.heavy.1.raw 22071
cgtatcgcctccctccgccatcagacagtatatacacgaccggtgctcgatttagagtatacatattgggtttgggggggagaggagcccagcactggattccgaggtgtttccattcggtgatcagcactgaacacagaggactcacatggagttttggctgagctgggttctccttgttggactttaaaaggtgtccagtgtgaggtgcggctgatggagtctggaggaggcttagtccagcctggggggtcccagagaactctctgtgcagcctctgggctcaccgtcagcagcaactacatgagttgggtccgccaggctccagggaaaggggctggagtgggtctcagtcatttatactggtgatttcacatactacgcagactccgtgaaggccgattcaccatctccagggacattccaggaacacggtttatcttcaaatgaacaacctgagaggcgacgacacggccgtctattactgtgcgagacaagtcggcgctttcggagtggttattattcgtttgacttctggggccagggaaccctggtcaccgtcgcctccgcctcccacccaagggcccatcggtcttccccctggcaccctcctccaagagcacctctggggcacagcggccctgggctgctggtcaaggactacttcctatatactgtctgagcgggctggcaggcgcatag

SEQ ID NO: 791009 - DNA, 653 bp, Homo sapiens
  misc_feature: 22097.44.86.H09.1.pb.heavy.1.raw 22097
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctctggagtttccatcagttctgatcattcttggggctggatccggcagcccccagggagggaatggagtggattggtgacatccattatactggggcgacgtactactctccgtccctcaagagtcgtctcaccatttcgagggacacgtcatgaaccgcttctccctgaaactgacctccgtgaccgccgcggacacggccgtttatttctgttgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 791010 - DNA, 685 bp, Homo sapiens
  misc_feature: 22148.44.53.E09.1.pb.heavy.1.raw 22148
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggcccgaatgaaacccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagctttggttctaatacggccaacccactccagccccttccctggagcctggcggacccaggtcatccaggcgttactgaaagtgaatccagaggctgcacaggagagtctaagggactccccaggctttaccaaacctcccccagactccaccaactgcacctcacactggacaccttttaaaatagcagcaaggaaaatccagctcagcccaaactccatggtgagtcctctgtgttcagtcctgatcactgaatgaaaacacctgggaaatcccaaggctggggctcctctcccagagctcaacacactctctctaaatcgagcaccggtcgtgtatatactgtctgatggcgcgagggaggcgatacg

SEQ ID NO: 791011 - DNA, 680 bp, Homo sapiens
  misc_feature: 22149.44.35.D02.1.pb.heavy.1.raw 22149
ctatgcgccttgccagcccgctcagacagtatataggaagtagtccttgaccaggcagcccagggccgctgtgccccagaggtgctcttggaggagggtgccagggggaagaccgatgggcccttggtggaggctgaggagacggtgaccagggttccctggcccaggggtcgagccagttcgcccccccgtctctactgtatcgataggaatctctcgcacaataatatacggccgtgtccgcggcggtcacagaagtcaatttcagggagaactggttcttggacctgtctagtgacatggtgactcgactcttgagggcggggttgtagttggtgctgccactgttataagatgcgcccaatccactccagtcccttcccggcggactgccgcagccaactccaataataactactgatgtaaaccaccagagacattgcaggtgagggacagggtctccgaaggcttcacccgtcctgggcccgactcctgcagctgcacctcggacacgacccatctgggaggtgccaccaggaggaggaagaaccacaggtgtttcatgttcttgtgcaggaggcccatgagtctcagaaagtatccccaaacccaaactatcgtgtgctaaatcgagcaccggtcgtgtatatactgtctgatggcgcgagggaggcgatacg

SEQ ID NO: 791012 - DNA, 600 bp, Homo sapiens
  misc_feature: 22158.UNK.UNK.UNK.pb.heavy.1.raw 22158
cccgacacgctgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctagggatggataggaaatagaatccaccctatcacccccccacatagcctgcttggggtgttgagtttattttatttcgtgttggaatgagttgaacttccgggaagtggagtaatgggtttgtctacttcccctaaccgcaaagtactagttttacgagtggcgttgcaagccatagccagtcacaggtaataaacattcaacgtggcgtaaagattggccgcttgctgtgggcattgcaagctggtttgcagcattgtgcgatgctagacgacaatatgaatctgcgggacccctagtggccaagatgccgctagcgggttccgcagcttttgacctggaccagggtgcatagcctgcccagcctt

SEQ ID NO: 791013 - DNA, 665 bp, Homo sapiens
  misc_feature: 22165.44.12.B01.1.pb.heavy.1.raw 22165
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 791014 - DNA, 706 bp, Homo sapiens
  misc_feature: 22169.44.73.G07.1.pb.heavy.1.raw 22169
cgtatcgcctccctcgcgccatcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtctgggggaggcgtggtccagcctgggaggtccctgagactctcctgtgaagcctctggattttagtttcagtagttctggcatgcactgggtccgccaggctccaggcaaggggccggagtggttggcagttatagcatatgatggaacttctagatattatgcagactccgtgaagggccgattcaccatctccagagacaattcccggaacactctgtacctggaaatgatcagcctgagaggcgaggactcggctctgtattactgtgcgagatcgggaagtggcagcagctattatcgggcgtttcactggggccaggggacactggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791015 - DNA, 651 bp, Homo sapiens
  misc_feature: 22172.44.86.H09.1.pb.heavy.1.raw 22172
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggagggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttcccctggcgccctgctccaggagcacctctggggcacagcggccctggctgccctggtcaaggactacttcctatatactgtctgagcggctggcaaggcgcatag

SEQ ID NO: 791016 - DNA, 708 bp, Homo sapiens
  misc_feature: 22207.44.56.F01.1.pb.heavy.1.raw 22207
ctatgcgcccttgccagcccgctcagacagtatataggaagtagtccttgaccaggcagccaggccgctgtgccccagaggtgctcctggagcagggcgccaggggaagaccgatgggccttggtggaagctgaagagacggtgaccattgtcccctggccccaaatatcaaatgcatcgacgtcccaggatcgcctggcgcagtaatagacgcctgtgtcgtcgggtctcaggttgctcatttgtaaatggccaacacactgttggagtcatccttgagacggtgaatcttcccttcacagacgcggcgttactctttacttccaccataacgtttcattctgacgaaagtgatccactcaagcccttccctggagcctgacggacccaggccaagtgataatcactaagactgaatcctgagacaacacaggagagtctcagagaccgccctggctgtgccaagccccccccccgactccgccagtcgcccctcgcactggacaccttctaaaaaaaactacaaggaaaatcaagattagcccaaactccatggttggtggtctgtgctcagtgctgatcaccaagtggaaactcctggaatctcacgctgggccctctcccagagctcccctttgtgtgttcagacgtctgctaatcgagcaccggtcgtgatagtatagactgatggcgcgaggaggcgatacg

SEQ ID NO: 791017 - DNA, 557 bp, Homo sapiens
  misc_feature: 22236.UNK.UNK.UNK.pb.heavy.1.raw 22236
ctatgcgcttgccagcccgctcagacagtatataggaagtagtccttgaccaggcagcccaggccgctgtgctcctcggaggtgctccgagcagggcgccagggggaagaccgatggcccttggtggaggctgaggagacggtgacccaggttccctggcccacagtcaagccaggtgctggtggctctcgcacagaatacacgcccgtgtcctcagatctcagctgctcagttccatgtagactgtacctgggaggtgctcggtcaatactaactcctgccttggaacttctgggcaaagcccgtgttgccactataggggcttcatcatcccatccactcccagccctgtccagcggctgtcgcacccagtaatatataattgatgaacgtgtatccagaagccgtgcagagactgtcactgagcccagcttcttcacctcagcagcgtgggtgaccgtgacctccagcaacttcggcacccaaacccaactactcacactaaatcgagccaccggtccgtgtatatactgtctgatggccgagggagcgatacg

SEQ ID NO: 791018 - DNA, 606 bp, Homo sapiens
  misc_feature: 22294.UNK.UNK.UNK.pb.heavy.1.raw 22294
cccgacacgcttggctaggacttggagctaaggacgacatattgcctttagacagtcgaaggtgacgccttagctaccactgaacgtttaggcgccagatgcggtctggatgacctaactcgcagcttatcgatgatctactgcacgctcaaccaaccaggtcttgatgcgcggcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggaccctagtggccaagatggccgctagcgggttccgcagctttgacctggaccagggtgcatagcctgcccagccttc

SEQ ID NO: 791019 - DNA, 695 bp, Homo sapiens
  misc_feature: 22322.UNK.UNK.UNK.pb.heavy.1.raw 22322
ctatgcgccttgccagcccgctcagacagtatataggaagtagtccttgaccaggcagcccagggccgctgtgctctcggaggtctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttcctggagcctggcggaccagtccattagtggtcactgatggtgaatccagagcgacacaggagagtctcagggaccctccaggctggaccaagtctccccgactccccaactgcacttcactctggacacctgtaaaataacaacaaggaaaacccagctcagcccgaactccatggtgagtcctctgtgttcagtgctgatcaccaaatgaaaaacacctggaattctggggctggggctccgctctcagagctccccaagagagatcgtgacgcagctaaatcgagcaccgtcgtgtatatactgtctgatggcgccgaggaggcgatacg

SEQ ID NO: 791020 - DNA, 662 bp, Homo sapiens
  misc_feature: 22326.44.21.B10.1.pb.heavy.1.raw 22326
ctatgcgccttgccagcccgctcagacagtatataggaagtagtccttgaccaggcagcccagggccgctgtgccccagaggtgctcttggaggagggtgccagggggaagaccgatgggcccttggggaggctgaggagacggtgaccgggtccctttgcccagacgtccatgtagtagtaatacttgtattgttgtaacttctggcgaccctctggcacagtaataaagggccgtgtcgtcactcgcaggctcttcatctgcagaaacaccgtattctggaattgtccctggagacgatgaagcggcccttcacggagtctgcgacatttgtggcactaccaccagtaatggatgagacccactccagccccttccctgggcctgacggacccagatcatggcataggtattaaaggcgaatccagaggctgcacaggagagtgtcagggacccccccggctgtaccaagcccccccgactccaacagctgcacttcacactggacaccttttaaaacagccacagaaagccagctcagccaaactccatgtgagttctctctgttcagtccccagggctgggcccctctctctgcgacgacactaaatcgagcaccggtcgtgtatatactgtctgatggcgcggagggaggcgatacg

SEQ ID NO: 791021 - DNA, 698 bp, Homo sapiens
  misc_feature: 22336.44.55.E11.1.pb.heavy.1.raw 22336
cgtatcgcctccctcgcgccatcagacagtatatacacgaccggtgctcgatttagcactcgcacgttgggtttgggagaggagcccagcactgggattccgaggtgtttccattcggtgatcagcactgaacacagaggactcaccatggagtttggctgagctgggttctccttgttggacttttaaaggtgtccagtgtgaggtgcggctgatggagtctggaggaggcttagtccagcctggggggtcccagagactctcctgtgcagcctctgggctcaccgtcagcagcaactacatgagttggtccgccaggctccagggaaggggctggagtgggtctcagtcatttatactggtgatttcacatactacgcagactccgtgaagggccgattcaccatctccagggacaattccaggaacacggtttatcttcaaatgaacaacccgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 791022 - DNA, 658 bp, Homo sapiens
  misc_feature: 22362.44.86.H09.1.pb.heavy.1.raw 22362
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgttctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaaccctggtcactgtctcctcagcttccaccaaggggcccatcggtcttccccctggcgccctgctccaggagcacctctgggggcacagcggccctgggctgcctggtcaaggactacttcctatatactgtctgagcgggctggcaaggcgcatag

SEQ ID NO: 791023 - DNA, 721 bp, Homo sapiens
  misc_feature: 22375.44.33.C11.1.pb.heavy.1.raw 22375
cgtatcgcctccctcgcgccatcagacagtatataccacgaccggtgctcgatttagagtgagctcgttgggtttggggctggagaggagcccagccaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgcaggcctccaggcaaggactggagtgggtggcacttatatggtatgatggaagtaataaatattatgtagattcgtgaagggccgattcaccatctccagagacaattcgaagaacacactatatctggaatgaatagcctgagagccgaggacacggctgtcttactactgtgcgagagatgggctcgtggatacagatatgacatgctctactccaatggtatggacgcctggggccaagggaccacggtcgccgtctcctcagcctccaccaggggccattcgtcttcccctggcaccctcctccaagagcacctctgggggcacagcggccctggctgcctggtcaaggactacttcctatatactgtctgagcgggctggcaaggcgcatag

SEQ ID NO: 791024 - DNA, 715 bp, Homo sapiens
  misc_feature: 22404.44.71.G05.1.pb.heavy.1.raw 22404
ctatgcgcctgccagcccgctcagacagtatataggaagtagtccttgaccagacagccccagggccgctgtgcccccagaggtgctcctggagcagggcgccagggggaagaccgatgggcccttggtggaagctgaagagacggtgaccattgtcccctggccccaaaatatcaaatgcatcgacgtcgccaggatcgcctggcgcagtaatagacgcctgtgtcgtccgggtctcaggtttgctcatttgtaaatggccaacactgttggagtcatccctttgagacggtgaatcttcccttcaacagacgcggcgtacttctttacttccaccataacgtttcattctgacgaaaagtgatccactcaagccccttccctggaagccctgaacggaacccaggcccaagtgataatcactaagactgaatcctgagactacacaggagagtctcagagaccggcctggctgtgccaagcccccccccgactccgccagtcgcccctcgcactggacaccttctaaaaaaaactacaaaggaaaatcaagattagcccaaactccatggttggtggtctgtgctcagtgctgaatcaccaagtggaaaactcctgggaatctcacggctggggctcctctctcttgcgacgacactaaatcgagcaccggtcgtgtatatactgtctggatggcgcgagggaggcgatacga

SEQ ID NO: 791025 - DNA, 703 bp, Homo sapiens
  misc_feature: 22452.44.36.D03.1.pb.heavy.1.raw 22452
cgtatcgcctccctcgcgccatcagacagtatatacacgaccggtgctcgatttagctgcgtcacgatctctcttgggggagagcggagcccagccccagaattcccaggtgttttcatttggtgatcagcactgaacacagaggacctcaccatggagttcgggctgagctgggtttttccttgttgttattttacaaggtgtccagagtgaagtgcagttggtggagtccggggaagacttggtccagcctggagggtccctgagactctcctgtgtcgcctctggatttcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaaactcattgattctgcgaatgactaacctgaaaaccgaggacacgggcatgtattattgtgtttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791026 - DNA, 716 bp, Homo sapiens
  misc_feature: 22482.44.62.F07.1.pb.heavy.1.raw 22482
cgtattcgccttgccggcctcgcgccatcagacagtatatcacgaccggtgctcgattagtagtcgcataaaggggaaaaggggagctctgagagaggagcccagccctgggattttcaggtgtcttcatttggtgaccaggaccgaacagagaagaagtctccatggagtttgggctgagctgcctttttcttgtggcttttttaaagggtgtcgtgtgtgaagtgcagttgttggagtctgggggggcctgattcggcctgggaggtccctgacccctctcctgtgcggcctctggattcacctttagtgcctatggcatgacctgggtccgccgggctccagggagggactggagtgggtctcaagtatcggagctggtggtgtcacttctacgggagactccgtgaagggccgcttcaccatttcccagggacaattcggcaggacaaattgtttctccaaatgaaaaacctgagacccgaggacacaggcgtctattactgtttgaaagccagggaccacggtgacccccatgacacctttagtacttggggccggggacagtgtgaccgtctcttcagcctccaccagggcccatcggtcttccccctggcgccctgctccaggagcacctccgagagcacagcggccctgggctgcctggtcaaggactacttctatatactgtctgagcgggctggcaaggcgcatag

SEQ ID NO: 791027 - DNA, 618 bp, Homo sapiens
  misc_feature: 22497.UNK.UNK.UNK.pb.heavy.1.raw 22497
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaatagaatccacccctatcaccccccccacatagctgcttggggtgttgagtttacttttatttcgtgttggaatgagtttgaacttccgggaagtgagtaaatggtttttgttctacttccgcctaaccgcaaagtactagttttacgagtggcgttgcaagccatagccagtcacaggtaataaacaattcaacgtggcggtaaagattggccgcttgctggtgggcattgcaagctggggtttgcagcattgtgcatggctagacgacaatattgaatctgcgggacccctagtggccaagatggccgctagcgggtttccgcagcttttgacctggacccagggtgcatagcctgcccagccttc

SEQ ID NO: 791028 - DNA, 661 bp, Homo sapiens
  misc_feature: 22538.44.86.H09.1.pb.heavy.1.raw 22538
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggagggaatggagtggattggtgacatccattatactgggggcgacgtactactctccgttcgcctcaagagtcgtctcaccatttcgagggacacgtccatgaaccggcttctccctgaaactgacctccgtgaccgccgcggacacggccgtttatttctgtgcgaggcgagactggtctttcaatctatgggggcccgtggcaccctggtcactgtctcctcagcttccaccaagggcccatcggtcttccccctggcgccctgctccaggagcacctctggggggcacagcggccctgggctgcctggtcaaggactacttcctatatactgtctgagcgggctggcaaggcgcatag

SEQ ID NO: 791029 - DNA, 545 bp, Homo sapiens
  misc_feature: 22549.44.38.D05.1.pb.heavy.1.raw 22549
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgtggtcccttggccccagacgtccataccgtagtagtagtatgcaactccccgaactcccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactatcagatactaaatcgagcaccggtcgtgtatatactgtctgatggcgcgagggaggcgatacg

SEQ ID NO: 791030 - DNA, 686 bp, Homo sapiens
  misc_feature: 22582.44.72.G06.1.pb.heavy.1.raw 22582
ctatgcgcttgccagcccgctcagacagtatataggagtagtccttgacaggcagcccagggccgctgtgctctcggaggtgctcctggagcagggcgccaggggggaagaccgatgggcccttggtggaggctgaggagacggtgaccaggttccctgaccccagtagtcaatgagccacccagcgcctcccgcacaataatacacagccgtgtcctcgactctcagactgttcatttgcagatacagtgagttcttggcgttgtctctggagatgtgaatcggcccttcacagagtccacatagtgtgtctcagttccatctttcttcatgatggccacccactccagccccttccctgggagcctggcggacccagttcatccaataactactaaggtgaatccagaggctgcacaggagagtcttcagggacccccaggctggaccaagcctcccccagactccaccagttgcacctcacactggacaccttctaaaatagcaacaagaaaaacccagctcagtcccaattccatggtgagtcctctgtgctcagtgctgatcaccaagggaaaggccttggagtccagggctaaggctcctctctcccttcccttgcagtcgtagctaaatcgagcaccggtcgtgtatatactgtctgatggcgcgagggaggcgatacg

SEQ ID NO: 791031 - DNA, 605 bp, Homo sapiens
  misc_feature: 22621.UNK.UNK.UNK.pb.heavy.1.raw 22621
gaaggctgggcaggctatgcaccctggtccaggtcaaagctgcggaacccgctagcggccatcttggccactagggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 791032 - DNA, 704 bp, Homo sapiens
  misc_feature: 22625.44.35.D02.1.pb.heavy.1.raw 22625
ctatgcgccttgccagcccgctcagacagtatataggaagtagtccttgaccaggcagcccagggccgctgtgcccccagaggtgctcttggaggaggggtgccaggggaagaccgatgggcccttggtggaggctgaggagacggtgaccagggttccctggccccaggggtcgagccagttcgccccccccgtcttctactgtatcgataggaatctctcgcacaataatatacggccgtgtccgcggcggtcacagaagtcaatttcagggagaactggttcttggacctgtctagtagacatggtgactcgactcttgagggcggaggttgtaagttggtgctgccactgttatagatgcgcccaatcaactccagtccccttcccggcggactgccgcagccaactccaataattaactactgatgtaaccaccagagacattgcaggtgagggacaggtgtctccgaaggcttcacccgtcctgggcccgacactcctgcttgccgcacctcgacacgaacccatctgggaaggctgccaccaggaggaggaaaaaaaccacatggtgtttcatggttcttggtgcgcaggaggccccatgagtctcagaaagtatccccaaaacccaaactatcgtgtgctaaatcgagcaccggtcgtgtatatactgtactgatgcgcgagggaaggcgatatcg

SEQ ID NO: 791033 - DNA, 693 bp, Homo sapiens
  misc_feature: 22631.44.36.D03.1.pb.heavy.1.raw 22631
cgtatcgcctccctcgcgccatcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctggttttccttgttgctatttagaaggtgtccactgtgaggtgcggctggtggagtctgggggagcttggtacagcgggggggtcctgagactctcctgtgcagcctctggattcatcttcagtgactatgccatgaactggtccgccaggctccagggaagggctggagtgggtttcatatgttaatattgctggagataccacctactacgcagactctgtgaagggccgattcaccaattccaggacaatgcaagaactcactgtatctggaaatgaacagcctgagagacgaggacacggctgtctacttctgttcgagagatcgggccactggtcagtggctggtttgactactgggccggggaaccctggtcaccgtctcctcagcctccaccaaggcccatcggtctccccctggcgcctgctccaggagcacctccgagagcacagcggcctggctgcctggtcaagactacttctatatactgtctgagcgggctggcaaggcgcatag

SEQ ID NO: 791034 - DNA, 703 bp, Homo sapiens
  misc_feature: 22647.44.56.F01.1.pb.heavy.1.raw 22647
ctatgcgcccttgccagccgctcagacagtatataggaagtatccttgaccaggcagcccagggcgctgtgccccagaggtgctcctggagcagggcgcagggggaaagaccgatgggcccttggtggaagctgaagagacggtgaccattgtcccctggccccaaatatcaaatgcatcgacgtcccaggatcgcctggcgcagtaatagacgcctgtgtcgtcgggtctcaggttgctcattttaatggccaacactgttggagtcatcccttgagacggtgaatcttcccttcacagacgcggcgtactctttacttccaccataacgtttcattctgacgaagtgatccactcaagccccttccctggagcctgacgacccaggccaagtgataatcactaagactgaatcctgagactacacaggaagagtctcagagaccgccctggctgtgccaagcccccccgactccgccagtcgccctcgcactggacaccttcctaaaaaactacaaggaaaatcaagattagcccaaactccatggttggtggtctgtgctcagtgctgatcaccaagtggaaaactcctggaatctcacggctggggctcctctccagcccctttgtgtgttcagacgtctgctaatcgagcaccggtcgtgtatatacttgtctgatggcgcgcgagggaggcgatacg

SEQ ID NO: 791035 - DNA, 595 bp, Homo sapiens
  misc_feature: 22655.UNK.UNK.UNK.pb.heavy.1.raw 22655
gaaggctggcaggctatgcaccctggtccaggtcaaaagctgcggaacccgctagcggccatcttggcactaggggtcccgcagattcatattgtcgtctagcatgcacaatgctgcaaccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatggggggggtgatagggtggattctattcctatccatcccctaggatctcaattaagttactagcgagttaaatgtctgtagcgatcccgtcagtcctatcgcgcgcatcaagacctggttggttgagcgtgcagtagatcatcgataagctgcgagttaggtcatccagccgcatctggcgcctaaacgttcagtggtagctaagcgtcaccttcgactgtctaaaggcaatatgtcgtccttagctccaagtcctagcaagcgtgtcgg

SEQ ID NO: 791036 - DNA, 620 bp, Homo sapiens
  misc_feature: 22763.UNK.UNK.UNK.pb.heavy.1.raw 22763
gaaggctgggcaggctatgcaccctggtccaggtcaaaagctgcggaacccgctagcggccatcttggccactaggggtcccgcagattcatattgtcgtctagcatgcacaatgcctgcaaaccccagcttggcaatgcccacagcaagcggccaatctttacgccacgttgaattgtttattacctgtgactggctatggcttgcaacgccacctcgtaaaactaagtacttttgcggtttaggggaagtagacaaacccattactccacttcccggaagttcaactcattccaacacgaaataaaagtaaactcaacacccaaagcaggctatgtggggggtgataggggtggattctattccctatcccatcccctaggatctcaattaagttactagcgagttaaatgtctgtagcgatcccgtcagtcctatcgcgcgcatcaagacctggttggttgagcggtgcagtagatcatcgataagctgcgagttaggtcatcccagaccgcatctggcggcctaaacgttcagtggttagctaaggcgtcaccttcgactgtctaaaggcaatatgtcgtccttagctccaaagtcccctagcaaagcgtgtcggg

SEQ ID NO: 791037 - DNA, 643 bp, Homo sapiens
  misc_feature: 22782.44.86.H09.1.pb.heavy.1.raw 22782
ctatgcgcccttgccagcccgataggaagtagtccttgaccagcagcccagggccgctgtgccccccagaggtgctcctggagcagggcgccagggggaagaccgatgggcccttggtggaagctgaggagacagtgaccagggtgccacggccccatagattgaaagaccagtcctcgcctcgcacagaaataaacggccgtgtccgcggcggtcacggaggtcagtttcagggagaagcggttcatggacgtgtccctcgaaaatgtgagacgactcttgagggacggagagtagtacgtcgccccagtataatggatgtcacaatccactccattcccctccctggggctgcggatcagccccaagaatgatcagaactgatggaaactccagagacagtgcagatgagaggacaggggttcccgaaggcctcaccagtcctgggcccgactcctgcagctgcacctgggacaggacccatctgggagctgccaccagcaggaggaaaaaaccacaggtgcttcatgttcttgcacaggaggtccttgactctcagaaagcatccccaacccaagtctatagcactaaatcgagcaccggtcgtgtatatactgtctgatggcgcgagggaggcgatacg

SEQ ID NO: 791038 - DNA, 678 bp, Homo sapiens
  misc_feature: 22789.44.55.E11.1.pb.heavy.1.raw 22789
ctatgcgccttgccagccgctcagacagtatataggaagtagtccttgaccaggcagccaggacgctgtgcccagaggtgctctggaggagggtgccaggggagagacgatgggcccttggtggaggcggaggcgacggtgaccagggttcctgccccagaagtcaaacgaataataaccactccgagcgccgacttgtctcgcacagtaatagacggccgtgtcgtcgcctctcagtttgttcatttgagataaacgtgttcctggaattgtcctggagatggtgaatcggccttcacggagtctgcgtagtatgtgaaatcccagtataaatgactgagacactccagccccttcctggagcctggcggaccaactcatgtagttgctgctgacggtgagcccagaggctgcacaggagagtctctggaccccgcaggctggactaagcctcctccagacccatcagccgcacctcacactggacactttaaaagtccacaaggagaacccagctcagccaaactccatggtgagtctctgtgttcagtgctgatcatcgaatggaacacctcggaatcccagtgctgggctcctctccccgccacccaacgtgcgagtgctaaatcgagcaccggtcgtgtatatactgtctgatggcgcgagggaggcgatacg

SEQ ID NO: 791039 - DNA, 687 bp, Homo sapiens
  misc_feature: 22829.44.27.C05.1.pb.heavy.1.raw 22829
cgtatcgcctccctcgcgccatcagacagtatatacacgaccggtgctcgatttagacgcgatcgaagggtttgggcggcctgggagaacgagcccagcactgaagtcgcggtgtttccactcggtgatcatcactgaacacagaggactcaccatggagtttggctgagctgggttttcctcgttgcctcttaagaggtgtcatgtgtcaggtgcaattcgtggagtctgggggaggcgtgccccagtagggggtccctgagactccctgtgcagcctctggattcaccttcgataatggaatatgcagtgggtccgccaggctccaggcgagggctggagtggtggcaggtgtgtcatttcatggaggaaatcaagtctacggtgattccgttgagggccgattcaccatctccagagacaattccgagaacacagtgtctcttcaaatgaacagcctgagactcaggacacgccgtgtatttttgtgcgagactatctgtttccaaatcggttcattcgacgcctgggccagggaacctggtcaccgtctcctcggcctccccaagggcccatcggtcttcccctggcgccctgctccaggagcacctcgagagcacagcggccctggctgcctggtcaggactacttcctatatactgtctgagcgggctggcaggcgcatag

SEQ ID NO: 791040 - DNA, 701 bp, Homo sapiens
  misc_feature: 22840.44.70.G04.1.pb.heavy.1.raw 22840
ctatgcgccttgccagcccgctcagacagtatataggaagtagtccttgaccaggcagccagggccgctgtgctctcggaggtgctcctggagcagggcgcaggggaagaccgatgggcccttggtggaggctgaggagacggtgaccagggtcccctggccccagtcatgcgcccggtaataactactaccacctcccgatctcgcacagtaatacagagccgagtcctcgactctcaggctgaccatttccaagtacacaatgttccgggaattgtctctggagatggtgaatcggcccttcacggagtctgcataatattcagaacttccatcatgtgctataactgccaaccactccggccccttgcctggagcctggcggacccagtgcatgccagaacactgaaactaaatccagaggcttcacaggagagtctcaggacctcccaggctggaccacgcctccccagactccaccaggtgcacctgacagtggacacctcttaaaagagcaacgaggaaaacccagctcagcccaaactccatggtgagtcctctgtgttcagtgctgatcaccgaatggaaacaccgccgacttctagtgctgggctcctctcccagaccctttcccttcacactacactaaatcgagcaccggtcgtgtatatactgtctgatggcgcgagggaggcgatacg

SEQ ID NO: 791041 - DNA, 694 bp, Homo sapiens
  misc_feature: 22846.44.27.C05.1.pb.heavy.1.raw 22846
cgtatcgcctcctcgcgccatcagacagtatatacacgaccggtgctcgatttagacgcgatcgaagggtttggggcctgggagacgagcccagcactggaagtcgccggtgtttcactcggtgatcatcactgaacacagaggactcaccatggagtttgggctgagctgggttttcctcgttgccctcttaagaggtgtcatgtgtcaggtgcaattcgtggagtctgggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggccagggaaccctggtcaccgtctcctcggcctccaccaagggcccatcggtcttccctggcgccctgctccagagcacctccgagagcacagcggccctggctgcctgtcaaggactacttcctatatactgtctgagcgggctggcaaggcgcatag

SEQ ID NO: 791042 - DNA, 713 bp, Homo sapiens
  misc_feature: 22849.44.27.C05.1.pb.heavy.1.raw 22849
cgtatcgcctccctcgcgccatcagacagtaatatacacgaccggtgctcgatttagacgcgatcgaagggtttggggcctgggagacgagcccagcactggaagtcgccggtgtttccactcggtgatcatccactgaacacagaggactcaccatggagtttgggctgagctgggttttcctcgttgccctcttaagaaggtgtcatgtgtcaggtgcaattcgtggagtctggggaaggcgtggccccagtaggggtccctgagactctcctgtgcagcctctggattcaccattcgataattggaatatgcagtgggtccgccaggctccaggcgaggggctggagtgggtggcaggtgtgtcatttcatggaggaaatcaagtctacggtgattccgttgagggccgattcaccatctccagaggacaattccgagaacacagtgtctcttcaaaaatgaacagcctgagacctcaggacacggaccgtgtatttttagtgcgagactatctgtttccaaaatcggttcattcgacgcctgggccagggaaccctggtcaccgtctcctcggcctccaccaagggcccatcggtctttccccctggcgcccctgctccaggagcacctccgagagcacagcggccctgggctgcctggtcaaggactacttcctatatactgtctgagcgggctggcaaggcgcatag

SEQ ID NO: 791043 - DNA, 715 bp, Homo sapiens
  misc_feature: 22883.44.85.H08.1.pb.heavy.1.raw 22883
cgtatcgcctccctcgcgccatcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtgtccagcctgggaggtccctgagactctcctgtgcagcgtctggattcaccttcagtacctatggcatgcactgggtccgccaggctccaggcaagggctggagtggtggcacttatatggtatgatggaagtaataaatactatgcagactccgtgaagggccgattcaccatctccagagacaattccaagacacgctgtatctgcaaatgaacagcctgagagccgaggacacggctgtgtattactgtgcgaggacatattgtagtactaccacctgctgggactactactacggtatggacgtctgggccaaggaccacggtcaccgtctcctcagcctccaccaagggccatcggtcttccccctggcaccctcctccaagagcacctctggggcacagcggccctgggctgcctggtcaaggactacttcctatatactgtctgagcgggctggcaaggcgcatag

SEQ ID NO: 791044 - DNA, 605 bp, Homo sapiens
  misc_feature: 22895.UNK.UNK.UNK.pb.heavy.1.raw 22895
cgtatcgcctccctcgcgccatcagacagtatatacacgaccggtggctcgattagctgcgtcacgatctctcttgggtcttgtcccaggtcaccttgaaggagtctggtcctgtgctggtgaaaccccacagagaccctcacgctgacctgcaccatctctgggttctctctcaacgatattagaatgggtgtgagctggatccgtcagcccccaggaaaggccctggagtggcttgcacacatcttctcgaatgacgaaaaatcctacagtacatctctgagagcagttaaccatctccaaggacacctccaaaaggcaggtggtctttagtatgaccaacatggaccctgcggacacaggcacatattactgtgcacgggtaatgcgggaaagaaacagctggtttctgtattataagtcttaccatctggacgtctgggcaaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 791045 - DNA, 700 bp, Homo sapiens
  misc_feature: 22903.UNK.UNK.UNK.pb.heavy.1.raw 22903
cgtatcgcctccctcgcgccatcagacagtatatacacggaccggtgctcgatttagtagctctatcagggggagcatcacataacaaccacattcctcctctaaagaagcccctgggagcacagctcatcaccatggactggacctggaggttcctctttgtggtggcagcagcaaacaggtgtccagtccctggtgcaactggtgcagtctgggactagaatgccgcaaaccttggtcctcggtgacccctttcctgcacggcctctggaagtactaccagttccactacttataccatcaactgggtgtgccaggcccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcacctcagcttccaccaagggcccatcggtcttccccctggcgccctgctcccaggagcacctctgggggcacagcggccctgggctgcctggtcaaggactacttcctatatactgtctgagcgggctggcaaggcgccatag

SEQ ID NO: 791046 - DNA, 666 bp, Homo sapiens
  misc_feature: 22925.44.12.B01.1.pb.heavy.1.raw 22925
ctatgcgccttgccagcccgctcagacagtatataggaagtagtccttgaccaggcagcccagggccgctgtgcccccagaggtgctcttggaggagggtgccagggggaagaccgatggcccttggtggaggctgaggagacggtgaccagggttccctggcccccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacagggacccatctgggagccgccaccagcaggaggaagaaccacaggtgcttcatgttcttgcacaggaggtccatgactctcagaaagcccccgcggaatctacactactaaatcgagcaccggtcgtgtatatactgtctgatggcgcgagggaggcgatacg

SEQ ID NO: 791047 - DNA, 628 bp, Homo sapiens
  misc_feature: 22927.UNK.UNK.UNK.pb.heavy.1.raw 22927
cccgacacgcttgctaggggactttggagctaaggacgacatattgcctttagacagtcgaaggtgacgccttagctaccactgaacgtttaggcgccagatgcggtctgggatgacctaacgtcgcagcttatcgatgatctactgcacgcctcaaccaaccaggtcttgatgcgcgcgataggactgacgggatcgctacagacatttaactcgctagtaagctgtaattgagatcctaggggatgggataggaaatagaatccacccctatcaccccccacatagcctggcttgggggtgttgagtttacttttattcgtgttggaatgaggttgaacttccgggaagtggagtatcgggtttgtctgggcttccctaaccgcaaagacgtagtttacgagtggcgttgcaagcccatagccagtcacaggtaataaacaattcaacgtggcgtaaagattggcccgcttgctgtgggcattgcaagctgggtttgcagcattgtgcatgctagaccgcacaatatgaaatctgcgggagcccccctagtggccaaagatggccgctagcgggttccgcagcttttgacctggacccagggtgcatagcctggcccaggccttcc

SEQ ID NO: 791048 - DNA, 677 bp, Homo sapiens
  misc_feature: 22931.UNK.UNK.UNK.pb.heavy.1.raw 22931
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccaggttccctggcccgaatgaaaccatcccagacagtaatagacggctgtgtcctcggtgttcaggctgttcatctgcagagacaccgtatcttttgaatcatctcttgagatggtgaatctgcctttcacggtgcagcgtagtctgctgtcccaccgtcagctttggttctaatacggccaaacccactccagcccttccctggagcctggcggacccaggtcatccaggcggttactgaaagtgaatccagaggctgcacaggagagtctaagggactcccaggctttaccaaacctcccccagactccaccaactgcacctcacactggacaccttttaaaatagcagcaaggaaaatccagctcagcccaaactccatggtgagtcctctgtgttcagtcctgatcactgatgaaacacctgggaatcccaaggctggctcctctcccagagctcaacacacctctctaatcgagcaccggtcgtggtatatactggtctgatggcgcgaggcgaggcgatacg

SEQ ID NO: 791049 - DNA, 700 bp, Homo sapiens
  misc_feature: 22944.44.55.E11.1.pb.heavy.1.raw 22944
ctatgcgccttgccagcccgctcagacagtatataggaagtagtcccttgaccaggcagcccagggcgctgtgccccagaggctcttggaggagggtgccaggggagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaaggataaaccgtgttcctggaattgtccctggagatggtgaatcggcccttcacggagtctgccgtagtatgtgaaatcaccagtataaatgactgagacccactccagccccttccctggagcctggcggacccaactcatgtagttgctgctgacggtgagcccagaggctgcacaggagagtctctgggaccccccccaggctggactaagcctcctccagactccatcagccgcacctcacactggacaccttttaaaagtccaacaggagaacccagctcagccaaaactccatggtgagtcctctgtgttcagtgctgatcaccgaatggaaacacctcggaatcccagggctgggctcctctccccaaacccaacgtgcgagtgctaatcgagcaccggtcgtgtatatactgtctgatggcgcgagggaggcgatacg

SEQ ID NO: 791050 - DNA, 718 bp, Homo sapiens
  misc_feature: 22979.44.85.H08.1.pb.heavy.1.raw 22979
ctatgcgccttgccagcccgctcagacagtatataggaagtagtccttgaccaggcagcccagggcgctgtgcccccagaggtgctcttggaggagggtgccaggggaagaccgatgggcccttggtggaggctgaggagacggtgaccgtggtcccttggcccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgcataggtactgaaggtgaatccagacgctgcacaggagagtctcagggacctcccaggctggaccacgcctcccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggctcctctcccagagctccccgcgactgagtgatactaatcgagcaccggtcgtgtatatactgtctgatggcgcgagggaggcgatacg

SEQ ID NO: 791051 - DNA, 598 bp, Homo sapiens
  misc_feature: 23011.44.78.H01.1.pb.heavy.1.raw 23011
cgtatcgcctccctcgcgccatcagacagtatatacacgaccggtgctcgatttagtgtgagtagtttggtttggggggaagaggaagactgacggtcccactcccaggtacagctggtgcagtctggggctgaggtgaagaagcctggggccctcagtgacagtctcctgcacggcttctggatacacgttcatcaattatgatattaactgggtgcgacaggccgctggacaagggctggagtggatgggatggatgaagccctatagtggcaacacgggctttgccagaagttccaaggcagagttagtatgaccaggagcaccttccccaggtacagtctacatggaactgagcagcctgagatctgaggacacggccgtgtatttctgtgcgagagccaccagcacctggcttgacttgtggggccagggaaccctggtcaccgtctcctcagcctccaccaaagggcccatcggtcttcccccctggcgcccctgctccaggagcacctccgagagcacagcggccctggcctgcctggtcaagggaactacttcctatatactgtctgagcgggctggccaaggcgcatag

SEQ ID NO: 791052 - DNA, 697 bp, Homo sapiens
  misc_feature: 23056.44.55.E11.1.pb.heavy.1.raw 23056
ctatgcgccttgccagcccgctcagacagtatataggaagtagtccttgaccaggccagccagggccgctgtgcccccagaggtgctcttggaggagggtgccaggggaagaccgatgggcccttggtggaggcggaggcgacggtgaccagggttccctggcccagaagtcaaacgaataataaccactccgagcgccgacttgtctcgcacagtaatagacggccgtgtcgtcgcctctcaggttgttcatttgaagataaaccgtgttcctggaattgtccctgagatggtgaatcggcccttcacggagtctgcgtagtatgtgaaatcaccagtataaatgactgagacccactccagccccttccctggagcctggcggacccaactcatgtagttgctgctgacggtgagccagaggctgcacaggagagtctctggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacactcggaatccagtgctggctcctctcccccccaaacccaacgtgcgagtgctaaatcgagcaccggtcgtgtatatactgtctgatggcgcgagggaggcgatacg

SEQ ID NO: 791053 - DNA, 713 bp, Homo sapiens
  misc_feature: 23075.44.36.D03.1.pb.heavy.1.raw 23075
ctatgcgccttgccagcccgctcagacagtatataggaagtagtccttgacccaggcagcccagggccgctgtgctctcggaggtgctcctggagcagggcgccagggggaagacgatgggccttggtggagggctgaggagacggtgaccagggttccctggccccagtggacagttcctgatataaacacaacacaataatacatgcccgtggtcctcgggttttcaggttagtcattcgcagaatcaatgagttctttgaagtcattctcttgagagggtgaatctggctttcacagacgcggcgtactctgtgataaagctggcaactttgttttttactcgcggccaagccactccagccccttccctggagcctggcggaccccagtccatatagtggtccctgatggtgaatccagaggcgacacaggaagatctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagaagagatcgtgacgcagctaaatcgagcaccggtcgtgtatatactgtctgatggcgcgagggaggcgatacg

SEQ ID NO: 791054 - DNA, 703 bp, Homo sapiens
  misc_feature: 23077.UNK.UNK.UNK.pb.heavy.1.raw 23077
cgtatcgcctccctcgcgcatcagacagtatatacaccgaccggtgctcgatttagctgcgtcacgatctctcttggggagctctgagagcggagccccagccccagaattcccaggtgtttttcattggtgatcaggcactgaacaacagaggactcaccatggagttcgggctgagctgggtttccttgttgttattttacaaggtgtccagagtgaagttgcagttgtgggagtccgggggagactggtccagcctggagggtcctgagactctcctgtgtcgcctctggattcaccatcagtgaccactatatggactgggtccgccaggctccagggaagggctggagtggcttggccgcagtaaaaacaaagttgccagcttttatcacagagtacgccgcgtctgtgaaagccagattcaccctctcaagagatgacttcaagaactcattgattctgcgaaatgactaacctgaaaaccgagacacgggcatgtattattgtgttgtgtttatatcaggaactgtccactggggcccagggaaccctggtcaccgtctcctcagcctcacaagggcccatcggtcttcccctggcgccctgctccaggagcacctccgagagcacagcggccctgggctgcctggtcaaggactacttcctatatactgtctgagcgggctggcaaggcgcatag

SEQ ID NO: 791055 - DNA, 679 bp, Homo sapiens
  misc_feature: 23079.44.53.E09.1.pb.heavy.1.raw 23079
ctatgcgccttgccagcccgctcagacagtatataggaagtagtcctttgaccaggcagccagggccgctgtgctctcggagtgctcctggagcagggcgccagggggaagccgatgggcccttggtggaggctgagggagacggtgaccagggttccctggcccgaatgaaacatcccagacagtaatagacggctgtgtcctcggtgttcaggctgttcatctgcagagacaccgtatcttttgaatcatctcttgagatggtgaatcctgctttcacgggtgcagcgtagtctgcctgtcccaccgtcagctttggttctaatacggccaacccactccagcccctttccctggagcctggcggacccaggtcatccaggcgttactgaaagtgaatccagaggctgcacaggagagtctaagggactccccaggctttaccaaacctcccccagactccaccaactgcactcacactggacaccttttaaaatagcagcaaggaaaatcagctcagcccaaactcatggtgagtcctctgtgttcagtcctgatcactgaatgaaaacacctgggaatccaaggctggggctcctctcccagagctcaacacactctctctaaatcgagcaccggtcgtgtatatactgtctgatggcgcgagggaggcgatacg

SEQ ID NO: 791056 - DNA, 608 bp, Homo sapiens
  misc_feature: 23081.UNK.UNK.UNK.pb.heavy.1.raw 23081
gaaggctggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgccagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 791057 - DNA, 654 bp, Homo sapiens
  misc_feature: 23087.UNK.UNK.UNK.pb.heavy.1.raw 23087
cgtatcgcctccctcgcggccatcagacagtatatacaccgacggtgctcgattagtgctatagacttgggtttgggatgctttctgagagtcaaggacctcctgtgcaagaacatgaagcacctgtggtttttcctcctgctggtggcagctcccagatgggtcctgtcccaggtgcagctgcaggagtcggcccaggactggtgaggccttcggaacccctgtctctcatctgcactgtctctggagtttccatcagttctgatcattcttgggctggatccggcagcccccagggaggggaatggagtggattggtgacatccattatactggggcgacgtactactctccgtccctcaagagtcgtctcaccatttcgagggacacgtccatgaaccgctttctcctgaaactgactccggtgaccgccgccggacacggccgtttatttctgtgcgaggcgagactggtctttcaatctatggggccgtggcaccctggtcactgtctcctcagcttccaccaagggcccatcggtcttccccccggcgccctgatcaggagcacctctgggggcacagcggccctgggctgcctggtcaagggactacttcctatatactgtctgagcgggctggcaaaggcgcatag

SEQ ID NO: 791058 - DNA, 699 bp, Homo sapiens
  misc_feature: 23092.UNK.UNK.UNK.pb.heavy.1.raw 23092
ataggaagtagtccttgaccaggcagcccagggccgctgtgcccccagaggtgctcttggaggagggtgccagggggaagaccgatgggcccttggtggaggctgaggagacggcgaccgtggtcccttggccccaggcgtccataccattggagtagagcatgtcatatctgtatccacgagcccatctctcgcacagtagtagacagccgtgtcctcggctctcaggctattcattttccagatatagtgtgttcttcgaattgtctctggagatggtgaatcggcccttcacgggaatcccctacataatatttattacttccatcataccatataagtgccacccactccagtcccttgcctggagcctggcggacccagtgcatgccatgtctgttgaaggtgaatccagacgctacacaggagagtctcaagcggcctcccaggctggaccacgcctcccccagactccaccagcttcacctgacactggacacctcttaaaagagcaacgaggaaaacccaggtcagcccaaactccatggtgagtcctctgtggttcggtgctgatcaccgactggaaacaccgccgacttctggtgctgggctcctctccagagctcccaaaacccaacgctcactctaaagagcaccgggtcgtgttatactgtcgatggcgcgagggaggccgatacg

SEQ ID NO: 791059 - DNA, 723 bp, Homo sapiens
  misc_feature: 23097.44.33.C11.1.pb.heavy.1.raw 23097
ctatgcgccttgccagcccgctcagacagtatataggaagtagtccttgaccaggcagccagggccgctgtgccccagaggtgctcttggaggagggtgccagggggaagacgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccggccgacttctggtgctgggctcctctcccagccccaaacccaacgagctcactctaaatcgagcaccggtcgtgtatatactgtctgatggcgcgagggaggcgatacg

SEQ ID NO: 791060 - DNA, 700 bp, Homo sapiens
  misc_feature: 23099.44.27.C05.1.pb.heavy.1.raw 23099
cgtatcgcctccctcgcgcatcagacagtatatacacgaccggtgctcgatttagacgcgatcgaagggttggggctgggagacgagcccagcactggaagtcgccggtgtttccactcggtgatcatcactgacacagaggactcaccatggagtttgggctgagctgggttttcctccgttgccctcttaagaggtgtcatgtgtcaggtgcaattcggttggagtctggggaggcgtggcccagtaggggggtccctgagacttctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtattttgtgcgagactatctgtttccaaaatcggtcattcgacgcctggggccagggaaccctggtcaccgtctcctcgcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791061 - DNA, 718 bp, Homo sapiens
  misc_feature: 23114.44.36.D03.1.pb.heavy.1.raw 23114
ctatgcgccttgccagcccgctcagacagtatataggaagtagtccttgaccaggcagcccagggccgctgtgctctcggaggtgctcctggagcagggcgccaggggaagacggcgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctgactttcacagacgcgggcgtactctgtgataaagctggcaactttgtttttactgcggccaagccactccagccccttccctggatgttttttgctggcggacccagtccatatagtggtcactgatggtgaatccagaggcgacacgaggagagtctcagggggcgacctccaggctggaccaagtctcccccggactccaccaactgcacttcactctggacaccttgtaaaaataacaacaaggaaaacccagctcagcccgaactccatggtgagtcctctgtgttcagtgctgatcaccaatgaaaacacctgggaattctggggctggggctccgctcctcaagctccccaagagagatcgtgacgcagctaaatcgagcaccggtcgtgtatatactgtctgatggcgcgagggaggcgatacg

SEQ ID NO: 791062 - DNA, 705 bp, Homo sapiens
  misc_feature: 23147.44.67.G01.1.pb.heavy.1.raw 23147
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcgaatcccagtgctgggctcctctcccccccaaacccaatatgtatactctaaatcgagcaccggtcgtgtatatactgtctgatggcgcgagggaggcgatacg

SEQ ID NO: 791063 - DNA, 697 bp, Homo sapiens
  misc_feature: 23156.UNK.UNK.UNK.pb.heavy.1.raw 23156
cgtatcgcctccctcgcgccatcagacagtatatacacgaccggtgctcgatttggcactcgcacgttgggtttgggagagagccagcactgggattccgacggtgtttcattcggtgatcagcactgaacacagaggactcaccatggagttttggctgagctggttctcctttgtggacttttaaaagtgtgtccagtgtgaggtgcggctgatggagtctgaggaggcttagtccagcctggggtcccagagactctcctgtgcagctctggctcacgtcagaagcagcaactacatgagttgggtccgccaggctccagggaaggctgagtgggtctcagtccatttatatcctggtgatttcacatactacgcagactccgtgaaggggcgattccatctccaggtgacaattccaggaacacggtttagtctcaaatgaacaacctgagaggcgacgacacggccgtctataatttactgtgctagagacagtcggcgctcggagtggttattattcgtttgactctggccaggaaccctcggtcaccgtcgcctccgcctctccaagggccatcggtcttccccctggcaccctcctcgcagatgcacctctggggcacagcggccctgggctgcctggtccaagatacttcctatatactgtcgatctggcggggctgcaaggccatag

SEQ ID NO: 791064 - DNA, 618 bp, Homo sapiens
  misc_feature: 23158.UNK.UNK.UNK.pb.heavy.1.raw 23158
ccgacacgcttgctagggacttggagcctaaaggacgaccatattgccctttttagacagtcgaaggtgacgccttgctaaccactgaacgtttaggccgccagatgctggtctgggatgacctaactcgcagcttatcgatgatctactgcacgctcaaccaaccaggtcttgatgcgcgcgataggactgacgggagtcgctacagacatttaactcgctagtaacttaattgagatcctaggggatgggataggaaatagaatccacccctatcaccacccccccacatagcctgcttggggtgttgagtttacttttatttcgtgtttggaatgagttgaacttccgggaagtggagtaatgggtttgtctacttcccctaaccgcaaagtactagttttacgagtggccgttgcaagccatagccagtcacaggtaataaacaattcaacgtgcgtaaagattggccgcttgctgtgggccattgcagctggtttgcagcattgtgcatgctagacgacaatatgaatctgcgggacccctagtggccaagatggcgctagcgggttccgcagcttttgacctggaccagggtgcatagcctgcccagccttc

SEQ ID NO: 791065 - DNA, 698 bp, Homo sapiens
  misc_feature: 23170.44.55.E11.1.pb.heavy.1.raw 23170
ctatgcgccttgccagcccgctcagacagtatataggaagtagtccttgaccaggcagcccagggccgctgtgcccccagaggtgctcttggaggagggtgccaggggaagaccgatgggcccttggtggaggcggaggcgacggtgaccagggttccctggcccagaagtcaaacgaataataaccactccgagcgccgacttgtctcgcacagtaatagacggccgtgtcgtcgcctctcaggttgttcatttgaagataaaccgtgttcctggaattgtcctggagatggtgaatcggccttcacggagtctgcgtagtatgtgaaatcaccagtataaatgactgagaccccactccagccccttccctggagcctggcggacccaactcatgtagttgctgctgacggtgagcccagaggctgcacaggagagtctctgggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctctctccccaaacccaacgtgcgagtgctaaatcgagcaccggtcgtgtatatactgtctgatggcgcgagggaggcgatacg

SEQ ID NO: 791066 - DNA, 719 bp, Homo sapiens
  misc_feature: 23180.UNK.UNK.UNK.pb.heavy.1.raw 23180
cgtatcgcctcccctcgccgcatcagacggcccagtcataatacacacgaccggtgcttcgatttagctgcgtcacgatctctcttctggggggagagcggagcccgcagcccagaattccaggtgttttcatttggatcagcactgaacacagaggactcaccatggagttcgggcctgagcctgggttttgccttgttgttattttacaggtgtccagagtgaagtgcagttgtggagtccgggcggagacttggtccagcctggagggtcctgagactctcctgtgtgtcgctctggatttcaccatcagtgaccactatatggactgggtcgccaggctccagggaaggggctggagtggcctgcggccgcagtaaaaacaagttgccagctttatcacagagtacgccgcgtctgtgaaaggccagattcaccctctcaagagatgacttcaagaactcattgattctgcgaatgactaacctgaaaaccgaggacacgggccatgtattattgtgttgtgtttatatcaggaactgtccactgggcccagggaaccctggtcaccgtctcctcagcctccaccaagggcccatcgtcttccccctggcgccctgctccaggagcacctccgagagcacagcggcccctgggcctgcctggtcaaggacttacttctcctatatactgtctgagcgggctggcaaggcgcatag

SEQ ID NO: 791067 - DNA, 677 bp, Homo sapiens
  misc_feature: 23184.44.53.E09.1.pb.heavy.1.raw 23184
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggcccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagcttggttctaatacggccaacccactccagccccttccctggagcctggcggacccaggtcatccaggcgttactgaaagtgaatccagaggctgcacaggagagtctaaggactccccaggcttaccaaacctccccagactccaccaactgcacctcacactggacacctttaaaatagcagcaaggaaatccagctcagcccaaactccatggtgagtcctctgtgttcagtcctgatcactgaatgaaaacacctgggaatcccaaggctggggctcctctcccagagctcaacacactctctctaaatcgagcaccggtcgtgtatatactgtctgatggcgcgagggaggcgatacg

SEQ ID NO: 791068 - DNA, 660 bp, Homo sapiens
  misc_feature: 23197.44.29.C07.1.pb.heavy.1.raw 23197
cgtatcgcctccctcgcgccatcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctgggtccgtcagcccccaggaaaggccctggagtggcttgcactcatttattgggatgatgataggcgctacagtccatctctgaagagcagactctccatcaccggagacgcctccaatacgcaggtgatccttagagtggccaacatggcccctgcggacacagccacatactactgcgcacacatgatcaactattataaaagtggtggttatgtgagtggctttgatatctgggccaagggacaatggtcaccgtctcttcagcctccaccaagggccatcggtcttcccctggcgccctgctccaggagcacctccgagagcacagcggcctgggctgcctggtcaaggactacttcctatatactgtctgagcgggctggcaaggcgcatag

SEQ ID NO: 791069 - DNA, 675 bp, Homo sapiens
  misc_feature: 23199.UNK.UNK.UNK.pb.heavy.1.raw 23199
cgtatcgcctccctcggcgccatcagacagtatatacacgacgcgtgctcgatttagctgcgtcacgatctctcttggggagagcggagcccagcccagaattccaggtgttttcatttggtgatcagcactgaacacagaggactcaccatggagttcgggctgagctggtttccttgttgtatttacaggtgtccagagtgaagtgcagttggtggagtccgggggagactggtccagcctggagggtccctgagactctcctgtgtcgctctggattcaccatcagtgaccactatatggactggcgtcgccaggctccagggaagggctggagtggcttgccgcagtaaaacaaagttgccagctttatcacagagtacgccgcgtctgtgaaagccagattcaccctctcaagagatgactcaagaactcattgattctgcgaatgactaactgaaaccgaggacacgggcatgtattattgtgttgtgtttatatcaggaactgtccacggggccaggaaccctggtcaccgtctcctcagcctcaccaagggccccatcgtcttctcccctgcgccctgctccagagcacctcgagagcacagccggcctgggctgctggtcaaggactacttcccatatactgtctgagcgggctgcaaggccatag

SEQ ID NO: 791070 - DNA, 716 bp, Homo sapiens
  misc_feature: 23217.UNK.UNK.UNK.pb.heavy.1.raw 23217
cgtatcgcctcctcgcgccatcagtctatactatcacgaccggtgctcgcgatttagtatcactcagtcgcggggagctctgggagaggagcccagcactagaagtcggcggtgtttccattcggtgatcagcactgaacacgcaggactcaccatggagttttggcctgagctgggttttcctcgtgctcttttagagggtgtccagtgtcaggtgcagctggtggagtctggggaggcgtggtccagcctggaggtccctgagactctcctgtgcagcgtctggatcaccttcagtacctatggcagcactgggtgcgccaggcctccaggcaagggctggaagtgggggtggcacttaatggtatgatggaagtaataaatactatgcagactccgtgaagggccgattcacctctccagagacaattccaaagaacacgctgtatctgcaaatgaacagcctgagagccgaggacacggctgtgtattactgtgcgaggactattgtagtactaccacctgctggactaactactacggtatggacgtctgggccaagggacccggcacccgtctcctcagctccaccaaggggccatcggtcttccccctggcaccctcctccaagagcacctcggggggcacgcggccctggcgggctgcgtcaaggactacttcctatatactggctggcgggctggcaaggcgcatag

SEQ ID NO: 791071 - DNA, 598 bp, Homo sapiens
  misc_feature: 23231.UNK.UNK.UNK.pb.heavy.1.raw 23231
ccgacacgcttgctagggacttggagctaaggacgacatattgcctttagacagtcgaaggtgacgccttagctaccactgaacgttaggcgccagatgcggtctggatgacctaactcgcagcttatcgatgatctactgcacgctcaaccaaccaggtcttgatgcgcgcgataggactgacgggatcgctacagacatttaactcgctagtaacttaattgagatcctagggatgggataggaaatagaatccacccctatcaccccccacatagcctgcttgggtgttgagtttacttttatttcgtgttggaatgagttgaacttccggaagtggagtaatggtttgtctacttcccctaaccgcaaagtactagttttacgagtggcgttgcaagccatagccagtcacaggtaataaacaattcaacgtggcgtaaagattggccgcttgctgtggcattgcagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 791072 - DNA, 630 bp, Homo sapiens
  misc_feature: 23232.UNK.UNK.UNK.pb.heavy.1.raw 23232
ctatgcgccttgccagcccgctcagacagtatataggaagtagtcctgaccaggcagccgcaggcgctgtgcccccagagtgctcttggaggaggtgccagggaagaccgatggcccttggtggaggctgaggagacggtgaccagggttccctggcccagtgtcaagtagttgtgacgaactgccctactctcgcacagtaatacacgccgtgtcgcgcggtcacagagctcagcttcaggagaactggtcttggacgtgtctactgatatggtgactcgactctgagggacggttgtagtaggtgctcccactataatagatactcccatcactccagccccttccctggggctgcggatccagcccagtagtaactactactgctgatggagccaccagagacagtgcaggtgagggacaggtctcgaaggcttcaccagtcctgggccgactctgcagctgcagctggacaggaccatctggagccgccaccagcaggaggagaaccacaggtgcttcatgttcttgcacaggaggtccatgactctcagaagccccgcggaatctacactactaaatcgagcacggtcgtgtatatactgtctgatgcgcgagggaggcgatacg

SEQ ID NO: 791073 - DNA, 725 bp, Homo sapiens
  misc_feature: 23248.UNK.UNK.UNK.pb.heavy.1.raw 23248
cgtatcgcctccctcgcgccatcagacagtatatacacgacggtgctcgatttagagtatacatattggggtttgggggggaggaggcccagcactggattccgaggtgtttccattcggtgatcagcactgaacacgaggactcaccatggagttttggctgaggctgggttcttccttgttggacttttaaaaggtgtccagtgtgaggtgcggctgatggagtctggaggggcgaggcttagtccagcctggggtcccagagactctcctgtgcagcctctgggctcaccgtcagcagcaactacatgagttgggtccgccaggctccagggaaagggctggagtgggtctcagtcatttatactggtgatttcacatactacgcagactccgtgaagggccgattccaccatctccaggcgacaattccaggacacgcggcggtttatcttcaaatgaacaaccctgagaggcgacgacacgcggccgtctattactgtgcgagacaagtcggcgctcggagtggttatttattcgttttgacttctggggcccagggaacgcctggtcaccgtcgcctccgcctccaccaagggcccatcggtcttcccccctggcagccctcctccaagagcacctctgggggcagccagcggcccctgggctgcctggtcaaggactacttcctatatactgtctgagcggcctggcaaggcgcatag

SEQ ID NO: 791074 - DNA, 676 bp, Homo sapiens
  misc_feature: 23251.44.71.G05.1.pb.heavy.1.raw 23251
cgtatcgcctccctcgcgccatcagacagtatatacacgaccggtgctcgatttagtgtcgtcgcaagagagaggggcccagccctgcggactgaacagagagaactcaccatggagtttgggctgagctggctttttcttgtggctgttttaaaaggtgtccagtgtgaagtgcagctgttggagtcggggggaggccttggtacagccggggggggtccctgacactctcctgtgcagcctctggattcgcctttaatacctatgccatgatctgggtccgtcaggcccagggaaggggctggagtgggtctcatccattactggtggtagtgccacaaatgtcgcagactccgtgaagggccgcttcatcgtctccagggacaattccaagaatacggtgtttctgcagatgaagagcctgcgagtggacgacacggcccctttattactgtgccagagggtcgcagaagttacaacaatacaagtattactactacatggacgtctggggcaaaggcgaccccggtcaccgtctctcagcctccaccaagggccccatcggtcttcccctggcaccctcctccaagagcacctctgggggcacagcggccctgggctgcctggtcaaggactacttccatatactgtctgagcgggctggcaaggcgcatag

SEQ ID NO: 791075 - DNA, 705 bp, Homo sapiens
  misc_feature: 23267.UNK.UNK.UNK.pb.heavy.1.raw 23267
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccaggggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactgacaccttttaaaagtccaacaaggagaacccagctcagccaaactcccatggtgagtcctctgtgttcagtgctgatcaccgaatggaaacacctcggaatcccagtgctgggctcctctccccaaacccaacgtgcgagtgctaaatcgagccaccggtcgtgtatatactggtctgatggcgcgagggaggcgatacg

SEQ ID NO: 791076 - DNA, 685 bp, Homo sapiens
  misc_feature: 23268.44.45.E01.1.pb.heavy.1.raw 23268
ctatgcgccttgccagcccgctcagacagtatataggaagtagtccttgacaggcagcccagggccgctgtgctctcggaggtgctcctggagcagggcgccaggggaagaccgattgggcccttggtggaggctgaggagacggtgaccagggcttccctggcccagtagaaacgatgggctcgtacaataatagagagccgagtcctcggcctctcaaattgttcatttgtagatacacggtgttctggaattgtctctggagacggagaatcggcccttcacggagtttccatagtattctttacttccatcagaccagatgactgccaccactccagccccttgcctggagcctggcgggaaccccagtgcatggcagagtcactgaaactgaggtccggacgcaacacaggagagtctcagggacgtcccaggctggaccacgcctccccagatccaccagctgaacctgacactggacacctcttaaaagagcaaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 791077 - DNA, 716 bp, Homo sapiens
  misc_feature: 23301.UNK.UNK.UNK.pb.heavy.1.raw 23301
ctatgcgccttgccagcccgctcagacagtatataggaagtagtccttgaccaggcagcccagggccgctgtgcccccagaggtgctcctggagcagggcgcagggggaagaccgatgggcccttggtggaagctgaagagacggtgaccattgtccctgccccaaatatcaaatgcatccgacgtccccaggatcgcctggcgcgcagtaatagacgcctgtgtcgtcggtctcaggttgctcatttgtaaatggcacccactgttggagtcatcccttgagacggtgaatcttcccttcacagacgcggccgtactctttacttccaccataacgtttcattcgacgaaagtgatccactcaagcccttccctggagcctgacggacccaggccaagtgataatcacttaagactgaatcctgagactacacaggagagttcagagacccggccctggctgtgccaagccccccccgactccgcaagtcgcccctcgcactggacaccttctaaaaaactacaagaaaatcaagattagccaaactccatggttggtggtctgtgctcagtgctgatcaccaagtggaaactcctggaatcctcacgtctgggagctcctctcccagagctcccctttgtgtgttcagacgtctgctaaaatcgagcgccggtcgtgtatatactgtctgatgcgcgcgaggaggagcgatacg

SEQ ID NO: 791078 - DNA, 639 bp, Homo sapiens
  misc_feature: 23365.UNK.UNK.UNK.pb.heavy.1.raw 23365
cgtatcgcctccctcgcgccatcagacagtatatacacgacggtgctcgatttagtgagtcagtaagggggactcctgtgccccaccatggacacactttgctccacgctcctgctgctgaccatcccttcatgggcctgtcccagatcaccgtgaaagagtctggccctacattggtgaaacccacacagaccctcacgctgacctgcaccgtctcaggcttctcactcgtcactcctggagagggcgttgtctgggtgcggcagccccccggaaaggcctgagtggatcgcactcacttattggaatgacgatatacgatatagtccttctctgacgaccagactcacgctcacgaaggacacgtccaaaaaccaggtggtccttacattgaccaacgtggaccctgtggacacaggcacatatttctgtgcccacttcatgaccacaatgaccacgggcttcttcgaaccctggggccagggaatccaggtcaccgtctcatcagcctccaccaaggcccatcgtcttcccctggcgccctgctcaggagcacctccgagagcacagcggccctgggctgcctggtcaaggactacttcctatatactgtctgagcgggctggcaagggcgcatag

SEQ ID NO: 791079 - DNA, 681 bp, Homo sapiens
  misc_feature: 23379.44.73.G07.1.pb.heavy.1.raw 23379
cgtatcgcctccctcggcgccatcagacagtatatacacgaccggtgctcgatttagctctacgctcaggggccgctgtgctctcggcggtggtttccattcggtgatcagcactgaacacagaggactcaccatggagtttgggctgagctgggttttcctcgttactcttttaagaggtgtccagtgtcaggtgcacctggtggagtctggggggaggcgtgtccagcctgggaggtcctgagactctcctgtgaagcctctggatttagtttcagtagttctggcatgcactgggtccgccagctccaggcaagggccggaagtggttggcagttatagcatatgatggaacttctagatattatgcagactcctgaaggccgattcaccatctccagagacaattcccggaacactctgtacctggaaatgatcacgctgagagcgaggactcggctctgtattactgtgcgagatcgggaagtggcagcagctattatcgggcgtttcactggggccaggggaccactggtcaccgtctcctcagctccaccaagggcccatcggtcttcccctggcgccctgctccaggagcacctccgagagcacagcggccctggctgcctggtcaaggactacttcctatatactgtctgagcgggctggcaaggcgcatag

SEQ ID NO: 791080 - DNA, 590 bp, Homo sapiens
  misc_feature: 23380.44.36.D03.1.pb.heavy.1.raw 23380
ccgctcagacagtatataggaagtagtccttgaccaggcagccccagggccgctgtgcccccagaggtgctcctgagcagggcgccaggggggaagaccgatgggcccttggtgaagctgaggagaacggtgaccgtggtccctttgccccagaccgtccagatggtaagacttataatacagaaaccagctgttttctttcccgcattacccgtgcacagtaatatgtgcctgtgtccgcagggtccatgtggtcatactaaagaccacctgccttttggaggtgtccttggagatggttaaactgctctcagagatgtgacgtaggatttttcgtcattcgaaagatgtgtgcaagccactccagggccttccctgggggctgacggatccagctcacacccattctaatatcgttgagagagaacccagagtggtgcagtcagcgtgagggtcctctgtgggtttcaccagcacagaccagaactccttcaaggtgacctgggacaagacccaagagagatcgtgacgcagctaaatcgagcaccggtcgtgtatatactgtctgatggcgcgagggaggcgatacg

SEQ ID NO: 791081 - DNA, 708 bp, Homo sapiens
  misc_feature: 23391.UNK.UNK.UNK.pb.heavy.1.raw 23391
cgtatcgcctcctcgcgccatcagacagtatatacacgaccggtgctcgatttagctgccgtcacgatctctcttggggagctctgagagcgcgagcccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccaggaaggggctggagtggcttggccgccagtaaaaacaaagttgccagctttatcacagagtacggccgccgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccccctggcgccctgctccaggagcacctccgagagcacagcggccctgggctgcctggtcaagggactacttcctatatactgtctgagcggctggcaaggcgcatag

SEQ ID NO: 791082 - DNA, 698 bp, Homo sapiens
  misc_feature: 23475.44.55.E11.1.pb.heavy.1.raw 23475
cgtatcgcctccctcgcgccatcagacagtatatacacgaccggtgctcgatttagcactcgcacgttgggtttggggggagaggagcccagcactggattccgaggtgtttccattcggtgatcagcactgaacacagaggactcaccatggagttttggctgagctgggttctccttgttggacttttaaaaggtgtccagtgtgaggtgcggctgatggagtctggagaggcttagtccagcctgggggtcccagagactctcctgtgcagcctctgggctcaccgtcagcagcaactacatgagttgggtccgccaggctccagggaaggggctggagtgggtctcagtcatttatactgtgatttcacatactacgcagactccgtgaaggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttcccctggcaccctcctccaagagcacctcggggcacagcggccctgggctgcctggtcaaggactacttcctatatactgtctgagcggggctggcaaggcgcatag

SEQ ID NO: 791083 - DNA, 715 bp, Homo sapiens
  misc_feature: 23533.UNK.UNK.UNK.pb.heavy.1.raw 23533
tatgcgcctttgccagcccgctcagacagtatataggaagtagtccttgaccagggcagcccagggccgctgtgctctcggaggtgctcctggagcaggcgccagggggaagaccgatgggcccttggtggaggctgaagagacggtcaccactgtccccgggccccaaagtactaaaggtgtcatggggggtcaccgtggtcctggctttcaaacagtatagacgcctgtgtcctcgggtctcaggtttttcatttggagaaacaatttgtcctgcgattgtccctggaaatggtgaagcgggcccttcacggagtctccgtagaaagtgacaccaccagctccggatacttgagacccactccagtcccctccctggagcccggcggacccaggtcattgccataggcactaaaggtgaatccagaggccgcacaggagagggtcagggacctccaggcgaatcaggccccccccagactccaacaactgcacttcacacacgacacccttttaaaaaagccacaagaaaaaaggcagctcagcccaaactccatggagacttctctctgttcggtcctggtcaccaaatgaagacacctgaaaatccaggctgggctcctctctcagagctcccctttcctttatgcgactactaaatcgagcaccgggtccgtgtatatactgttcctgatggcgcgagggaggcgatacg

SEQ ID NO: 791084 - DNA, 695 bp, Homo sapiens
  misc_feature: 23537.44.55.E11.1.pb.heavy.1.raw 23537
ctatgcgccttgccagcccgctcagacagtatataggaagtagtccttgaccaggcagcccagggccgctgtgccccagaggtgctcttggaggaggtgccagggggaagacgatgggcccttggtggaggcggaggcgacggtgaccagggttccctggcccagaagtcaaacgaataataaccactccgagcgccgacttgtctcgcacagtaatagacggccgtgtcgtcgcctctcaggttgttcatttgaagataaatcgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagccagaggctgcacaggagagtctctggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctctctccccaaacccaacgtgcgagtgctaaatcgagcaccggtcgtgtatatactgtctgatggcgcgagggaggcgatacg

SEQ ID NO: 791085 - DNA, 691 bp, Homo sapiens
  misc_feature: 23541.UNK.UNK.UNK.pb.heavy.1.raw 23541
ctatgcgccttgccagcccgctcagacagtatataggaagtagtccttgaccaggcagccagggccgctgtgcccccagaggtgctcctggagcagggcgccagggggaagaccgatggcccttggtggaagctgaggtgacaatgaccagggttccctgcccccagatctcaaaggctccatgcgagcgggggtacgacctctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaaagagggatgattccacccatccactcaagcccttgtccaggggcctggcgcacccagttgatggtataagtagtggaactggtagtacttccagaggccgtgcaggaagggtcaccgaggaccaaggttgcggcattctagtcccagactgcaccagttgcaccagggactggacacctgttgctgctgccaccacaaagaggaacctccaggtccagtccatggtgatgagctgtgctcccaggggcttctttagaggaggaatgtggttgttatgtgatgctccccctgatagagctactaaatcgaggcaccggtcgtgatagtatagactgatggcgcgagggaggcgatacg

SEQ ID NO: 791086 - DNA, 607 bp, Homo sapiens
  misc_feature: 23550.UNK.UNK.UNK.pb.heavy.1.raw 23550
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttccccggaagttcaactcattccaacacgaaataaaagtaaactcaacaccccaagcaggctatgtggggggtgataggggtggattctatttcctatcccatccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 791087 - DNA, 706 bp, Homo sapiens
  misc_feature: 23552.44.55.E11.1.pb.heavy.1.raw 23552
cgtatcgcctccctcgcgcgccatcagacagtatatacacgaccggtgctcgatttagcactcgcacgttgggtttggggagaaggagcccagcactgggattccgaggtgtttccattcggtgatcagcactggaacacagaggactcaccatggagtctttggctgagctgggttctccttgttggacttttaaaaggtgtccagtgtgaggtgcggctgatggagtctgggaggaggcttagtccagcctgggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacattccaggaacacggtttatcttcaatgaacaacctgagaggcgacgacacggccgtctattactgtgcgagacaagtcggcgctcggagtggttattattcgtttgacttctgggccagggaaccctggtcaccggtcgcctccgcctccacccaagggcccatcggtcttccccctggcacctcctccaagagcacctctgggggcacacgcgccctgggctgcctggtcaaggactacttcctatatactgtctgagcgggctggcaaggcgcatag

SEQ ID NO: 791088 - DNA, 642 bp, Homo sapiens
  misc_feature: 23556.44.86.H09.1.pb.heavy.1.raw 23556
cgtatcgcctccctcgcgccatcagacagtatatacacgaccggtgctcgatttagtgctatagacttgggtttgggatgctttctgagagtcaaggacctctgtgcaagaacatgaagcacctgtgttttttcctcctgctggtggcagctccagatggtcctgtcccaggtgcagctgcaggagtcgggcccaggactggtgaggccttcgggaaccctgtctctcatctgcactgtctctggagtttccatcagttctgatcattcttggggctggatccggcagcccagggagggaatggagtggattggtgacatccattatactgggcgacgtactactctccgtccctcaagagtcgtctcaccatttcgagggacacgtccatgaaccgcttctccctgaactgacctccgtgaccgccgcgacacggccgtttatttctgtgcgaggcgagactggtctttcaatctatggggccgtggcaccctggtcactgtctcctcagcttccaccaaggccatcggtcttccccctggcgccctgctccaggagcactctgggggcacagcggccctgggctgcctggtcaaggactacttcctatatactgtctgagcgggctggcaaggcgcatag

SEQ ID NO: 791089 - DNA, 710 bp, Homo sapiens
  misc_feature: 23567.UNK.UNK.UNK.pb.heavy.1.raw 23567
tatgcgccttgccagcccgctcagacagtatataggaagtagtccttgaccaggcagcccagggcccgctgtgctctcggaggtggctcctggagcagggcgccagggggaagaccgatgggccccttggtggaggccgaggagacggtgaccagggtttccctggccccaggcgtcgaatgaaccgatttggaacagatagtctcgcacaaaatacacggccgtgtcctgagggtctcaggacctgttcatttgaagagacactgtgttctcggaattgtctctggagatggtgaatcgccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccatactggggccacgcctcccccagactccacgaattgcacctgacacatgacacctcttaagagggcaacgaggaaacccagctcagcccaaactccatggtgagtccctctgtttcagtgatgatcaccgagtggaaacaccggcgacttccagtgctgggctcgtctccagccccaaacccttcgatcgcgtctaaatcgagcaccggtccgtgatatatatactgtctgatgggcgcgagggagggcgatacg

SEQ ID NO: 791090 - DNA, 652 bp, Homo sapiens
  misc_feature: 23572.UNK.UNK.UNK.pb.heavy.1.raw 23572
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccacggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttccgaaggcctcaccagtcctgggcccgactcctgcagctgcacctgggacagggacccatctgggagctgccaccagcaggaggaaaaaccacagtgcttcatgttcttgcacaggaggtccttgactctcagaaagcccccaatccctaatcacgtgtactaaatcgagcaccggtccgtgtatatactgtctgatggcgcgaggaggcgatacg

SEQ ID NO: 791091 - DNA, 694 bp, Homo sapiens
  misc_feature: 23575.44.72.G06.1.pb.heavy.1.raw 23575
cgtatcgcctccctcgcgccatcagacagtatatacacgaccggtgctcgatttagctacgactgcaagggaaaggggagagaggagccttagccctggactccaaggcctttccacttggtgatcagcactgagcacagaggactcaccatggaattgggactgagctgggttttcccttgttgctattttaagaaggtgtccagtgtgaggtgcaactggtggagtctgggggaggcttggtccagcctggggggtcccctgagactctcctgtgcagcctctggattcacctttagtagttattggatgaactgggtccgccaggctccagggaaggggctggagtgggtggccatcatgaagaaagatggaactgagacacactatgtggactctgtgaagggccgattcaccatctccagagacaacgccaagaactcactgtatctgcaaatgaacagtctgagagtcgaggacacggctgtgtattattgtgcgggaggcgctgggtggctcattgactactggggtcagggaaccctggtcaccgtctcctcagcctccaccaagggcccatcggtcttcccctggcgccctgctccaggagcacctccgagagcacagcggccctgggctgcctggtcaaggactacttcctatatactgtctgagcggctggcaaggcgcatag

SEQ ID NO: 791092 - DNA, 743 bp, Homo sapiens
  misc_feature: 23576.UNK.UNK.UNK.pb.heavy.1.raw 23576
cgtatcgcctccctcgcgccatcagaccagtatatacacgaccggtgctcgatttaagtgctatagactttgggttggggagctctgggagagggagcccagccaccagaaagtcggcggtgttttcccagtcggtgatcagcaccgaaccacagaggaactcaccatggagtttgggctgacctgggtttttcctcgttgctcttttaagaggtgtccagtgtcaggtgaagctgggggagtctgggggaggcgtggtcccagctgggaggtccctgagactctcctgtgtagcgtctggattcaccttcaacagacatggcatgcactgggtccgccaggctccaggcaagggactggaagtgggtggcacttatatggtatgatggaagtaataaatattatgtagattccgtgaagggccgattcaccatctccagagaccaattcgaagaacacacctatatctggaaatgaatagcctgagagccgaggacacggctgtctactactgtgcgagagaatggggctcgtggatacagatatgacatgctctactccaatggtatggacgcctggggccaagggaccacggtcgccgtctcctcagcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 791093 - DNA, 719 bp, Homo sapiens
  misc_feature: 23585.44.85.H08.1.pb.heavy.1.raw 23585
ctatgcgcctgccagcccgctcagacagtatatagaagtagtccttgaccaggcagcccagggccgctgtgcccccagaggtgctcttggaggagggtgccaggggaaagaccgatgggcccttggtggaggctgaggagacggtgaccgtggtcccttggccccagacgtccatacgtagtagtagtcccagcaggtggtagtactacaatatgtcctcgcacagtaatacacagccgtgtcctcggctctcaggctgtttcatttgcagatacagcgtgtcttgaattgtctctggagatggtgaatcggcccttcacggagttctgcatgtatttattacttccatcataccatataagtgccaccccactccagccccttgcctggagcctgcggacccagtgcatgccataggtactgaaggtgaatccagaacggctgcacagagagtctcagggacctcccaggctggaccacgcctcccccagactacaccagctgcacctgacactggacacctcttaaaagagcaacgaggaaaacccagctcagcccaaactcccatggtgagtcctctgtgttcagtgctgatcaccgaatgaaacaccgccgacttctagtgctgggctcctctcccagagctcccgctgactgagtgatactaaatcgagcaccggtcgtgtatatactgtctgtggcgcgagggaggcgatacg

SEQ ID NO: 791094 - DNA, 675 bp, Homo sapiens
  misc_feature: 23645.UNK.UNK.UNK.pb.heavy.1.raw 23645
ctatggcgccttgccagcccgctcagacagtatataggaagtagtcttgaccaggcagcccagggccgctgtgcccccagaggtgcctcctggagcagggcgccagggggaagaccgatgggcccttggtggaagctgaggagacggtgaccgtggtcccttgggccccagacgtccataccgtagtagtagtatgcaactcccccgaactcccgcaccggctcttgcacagtaaatacacagccgtgtcctcggctctcagactgttcatttgcagatacagcgtgttcttggcgttgtctctggagatggtgaatcgggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggacccccaggctgaactaagcctcccccatgccacggtgcccagagcccaatcttgtgacacacctccccgtgcccaaggtgcccagcaccctgaactcctggggaggaccgtcagtcttcctcttccccccaaacccaactatcagaatactaaatcgagcaccggtcgtgtatatactgtctgatggcgcgagggaggcgatacg

SEQ ID NO: 791095 - DNA, 571 bp, Homo sapiens
  misc_feature: 23671.44.36.D03.1.pb.heavy.1.raw 23671
ctattgcgcctgccagcccgctcagacagtatataggaagtagtccttgaccaggcagccagggccgctgtgccccagaggctgctcttggaggagggtgccaggggaagaccgatggcccttggtggaggctgaggagacggtgaccagggttccctggcccagtagtcaaaagaacttcttttcttgcttgtcctctaccggtctcgcacagtagtacacatctatgtcctcagatctctgactgctcagctccatgtgtaggctgtgctcgtggacgtgtcccctggtcatggtgactctgccctgaaacttctgtgcatagcctgtgttaccattgccagagtactccctaccatcattcaaaccttatccaggggcgctgtcacacacagtgaatgtcgtagctggcgaaggtgtatccagagctttgcaggagaccttcactgagccatggacgctggcacaggagagtcatcagaagctgggtcccccaagagagatcgtgacgcagctaaatcgagcaccggtcgtgtatatactgtctgatggcgcggagggaggcgatacg

SEQ ID NO: 791096 - DNA, 598 bp, Homo sapiens
  misc_feature: 23678.UNK.UNK.UNK.pb.heavy.1.raw 23678
aggctgggcaggctatgcaccctggtccaggtcaaaagctgcggaacccgctagcgggccatcttggcactagggtcccgcagattcatattgtcgtctagcatgcacaatgctgcaaaccagcttgcaatgccacagcaagcggcaatctttacgccacgttgaattgtttattacctgtgactggctatggcttgcaacgccactcgtaaactagtactttgcggttaggggaagtagacaaacccattactccacttcccggaagttcaactcattccaacacgaaataaagtaaactcaacaccccaagcaggctatgtggggggggtgataggggtggattctatttcctatcccatcccctaggatctcaattaagttactagcgagttaaatgtctgtagcgactcccgtcagtcctatcgcgcgcatcaagacctgttggttgagcgtgcagtagatcatcgataagctgcgagttaggtcatcccgacgcatctgcggccaaacgttcagtggtagctaaggcgtcaccttcgactgtctaaaggcatatgtcgtccttagctccaagtcgcctagcaagcgtgtcggg

SEQ ID NO: 791097 - DNA, 636 bp, Homo sapiens
  misc_feature: 23699.44.23.C01.1.pb.heavy.1.raw 23699
cgtatcgcctccctcgcgccatcagacagtatatacacgaccggtgctcgatttagtacacgtgattagggattggggcttctgagagtcaaggacctcctgtgcaagaacatgaagcacctgtggtttttcctctgctggtggcagctcccagatgggtcctgtcccaggtgcagctgcaggagtcgggcccagactgtgaggccttcgggaacctgtctctcatctgcactgtctctgagtttccatcagttctgatcattctgggctggatccggcagccccagggagggaatggagtggatggtgacatccattatactggggcgacgtactactctccgtcctcaagagtcgtctcccatttcgagggacacgtccatgaaccgcttctccctgaaactgacctccgtgaccgccgcggacacgccgtttatttctgtgcgggccgagactggtctttccaatctatgggccgtgcaccctgtcactgtctcctcagcttccaccaagggcccatcgggtcttccccctggcgccctgctccaggagcacctctgggggcacagcgccctggctgcctggtcaaggactacttcctatattactgtctgagcgggctggcaaggcgcatag

SEQ ID NO: 791098 - DNA, 649 bp, Homo sapiens
  misc_feature: 23709.44.86.H09.1.pb.heavy.1.raw 23709
cgtatcgcctcctcgcgccatcagacagtatatacacgaccggtgctcgatttagtgctatagacttgggttgggatgctttctgagagtcaaggacctcctgtgcaagaacatgaagcacctgtggtttttcctcctgctggtggcagctcccagatgggtcctgtccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagctccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 791099 - DNA, 716 bp, Homo sapiens
  misc_feature: 23775.44.55.E11.1.pb.heavy.1.raw 23775
cgtatcgcctccctcgcgccatcagacaggtatatacacgaccggtgctcgatttagcactcgcacgttgggtttgggggggagaggagccagcacctgggattccgaggtgtttccattcggtgatcagcactgaacacagaggactcaccatggagtttttggctgagctgggtttctccttgtggacttttaaaaggtgtccagtgtgaggtgcggctgatggagtctggaggaggcttagtccagcctgggggtcccagagactctcctgtgcagcctctggggctcaccgtcagcagcaactacatgagttgggtccgccaggctccagggaaggggctggagtgggtctcagtcatttatactggtgattttcacatactacgcagactccgtgaagggcccgattcaccatctccagggacaattccaggaacacggtttatcttcaatgaacaacctgagaggcgacgaacggccgtctattactgtgcgagacaagtcggcgctcggagtggtttatttcgtttgacttctgggggccagggaaaccctgggtcaccgtcgcctccgcctccaccaaggcccatcggtcttcccctggcaccctccctccaagagcacctctgggggcacagcggcctgggctgcctggtcaagggactacttggctatatactgtctgagcgggctggcaaggcgcatagtctctc

SEQ ID NO: 791100 - DNA, 712 bp, Homo sapiens
  misc_feature: 23779.UNK.UNK.UNK.pb.heavy.1.raw 23779
ccttgcgccttgccagccgctcagacagctactaagcaaagtacctccttgaccaggcagcccagggccgctgtgctctcggaggtgctcctggagcagggcgccaggggggaagaccgatgggcccttggtggaggccgaggagacggtgaccaggggttccctggccccaggcgtcgcaatgaaccgattttggaaacagatagtctcgcacaaaaatacacggcgtgtccctgaggtctcaggctgtttcatttgaagagacactgtgttctcggaattgtctctggagatgtgaatcggcccctcaacggaatcaccgtagacttgatttcctccatgaaatgacacactgccacccactccagcccctcgccctggagcctggcggacccactgcatattccattatcgaaggtgaatccagaggctgcacaggagagtctcagggacccccctactggggccacgccctcccccagactccacgaattgcacctgacacatgacacctcttaagagggcaacgaggaaaacccagctcagcccaaactccatggtgagtcctctgtgttcagtgatgatcaccgagtgaaacacgcggcgacttccagtgctgggctcgtctcccagcccaaacccttcgatcggcgtctaatcgagcaccggtcgtgtatatactgtctgatggcgcgagggaggaggcgatacg

SEQ ID NO: 791101 - DNA, 700 bp, Homo sapiens
  misc_feature: 23786.44.27.C05.1.pb.heavy.1.raw 23786
ctatgcgccttgccagcccgctcagacagtatataggaagtagtccttgaccaggcagcccagggccgctgtgctctcgggaggtgctcctggagcagggcgccagggggaagacgatgggcccttggtggaggccgaggagacggtgaccagggttcctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggcctcaacggaatcaccgtagacttgatttcctcatgaaatgacacacctgccacccactccagccctcgcctggagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagccccaaaccctttcgatcgcgtctaaatcgagcaccggtcgtgtatatactgtctgatggcgcgaggaggcgatacg

SEQ ID NO: 791102 - DNA, 707 bp, Homo sapiens
  misc_feature: 23796.44.55.E11.1.pb.heavy.1.raw 23796
cgtatcgcctccctcgccgcgcatcagacagtatatacacgaccggtgctcgatttagcactcgcacgttgggtttggggagaggagcccagcactgggattccgaggtgtttccattccggtgatcagcactgaacacagaggactcaccatgggagttttggctgagctgggttctccttgttggacttttaaaaggtgtccagtgtgaggtgcgactgatggagtctggaggaggcttagtccagcctgggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactggtgcgagacaagtcggcgctcggagtggttattattcgtttgacttctggggccagggaaccctggtcaccgtcgcctccgcctccaccaagggcccatcggtcttccctggcaccctcctccaagagcacctctgggggcacagcggccctgggctgcctggtcaaggactacttcctatatactgtctgagcgggctggcaaggcgcatag

SEQ ID NO: 791103 - DNA, 646 bp, Homo sapiens
  misc_feature: 23811.UNK.UNK.UNK.pb.heavy.1.raw 23811
cgtatcgcctccctcgcgcccatcagacagtatatacacgaccggtgctcgattagccgatatagttgggtttgggatgcttctgagagtcaaggacctcctgtcaagaacatgaagcacctgtggtttttccctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggaggggaatggagtggatggtgacatccattatactggggcgacgtactactctccgtccctcaagagtcgtctcaccatttcgagggacacgtccatgaaccgcttctcctgaaactgacctccgtgaccgccgcggacacggccgtttatttctgtgcgaggcgagactggtctttcaatctatgggccgtggcaccctggtcactgtctcctcagcttccaccaagggcccatcggtcttcccctggcgccctgctccaggagcacctctggggcacagcggccctgggctgcctggtcaaggactacttcctatatactgtctgagcgggctggcaaggcgcatag

SEQ ID NO: 791104 - DNA, 706 bp, Homo sapiens
  misc_feature: 23826.44.36.D03.1.pb.heavy.1.raw 23826
ctatgcgccttgccagcccgcttcagacagtatataggaagtagtccttgaccaggcagcccagggcgctgtgctctcggaggtgctcctggagcagggcgccagggggaagaccgatgggcccttggtggaggctgaggagacggtgaccagggttcctggccccagtggacaggttcctgatataaacacacacacaataaccatgccgtgtccctcggttttcaggttagtcattccgcagatcaatgagttccttgaagtcatctcttgcgagggtgaatctggctttcacagacgcggcgtactctgtgataaagctggcaactttgtttttactgcggccaagccactccagccccttccctggagcctggcggacccagtccatatagtggtcactgcatggtgaatccagaggcgacacaggagagtctcagggaccctccaggctggaccaagtctccccggactccaccaactgcacttcactctggacaccttgtaaaataacaacaaggaaacccagctcagcccgaactcatggtgagtctctgtgttcagtgctgatcaccaaatgaaaacacctgggaattctggggggctggggctccgctctcagagctcccaagagagatccgtgacgcagctaaatcgagcaccggtcgtgtatatactgtctgatgggcgcgagggaggcgatacg

SEQ ID NO: 791105 - DNA, 646 bp, Homo sapiens
  misc_feature: 23827.44.23.C01.1.pb.heavy.1.raw 23827
cgtatcgcctccctcgcgccatcagacagtatatacacgaccggtgctcgattagtacacgtgattagggattggggctttctgagagtcaaggacctcctgtgcaagaacatgaagcacctgtggttttcctcctgctggtggcagctccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttcccctggcgccctgctccaggagcacctctggggcacagcggccctgggctgcctggtcaaggactacttcctatatactgtctgagcggctggcaaggcgcatag

SEQ ID NO: 791106 - DNA, 734 bp, Homo sapiens
  misc_feature: 23834.44.27.C05.1.pb.heavy.1.raw 23834
ctatcggcgcttccagcccgcgtcagacaggtatataggaaagtagcgccttgaccaggcagccgccagggcgctgtgctctctcggaggtgctcctggagcaggggcgccagggggaagaccgatgggccctttggtggaggccgaggagacggtgaccagggttcccctgcggccccaggcgtcgaatgaacccgattttggaaacagatagtctcgcacaaaaatacacggccgtgtcctgagccgtgtctcaggtgcgttcattgaaagagacactgtgttctcgcgaattgtctctggagatggtgaatcggcgccctcaacggaatcaccgtagacttgatttcctccatgaaatgacacacctgccaccactccagcccgccgcctggagcctggcggacccactgcatattccaattatcgaaggtgaatccaagggctgcacaggagagtctcagggacccccccctactggggccacgcctccccagactcccacgaattgcacctgacacatgacacctcttaacgaggggcaacgaggaaaacgccagctcagcccaaaactccatggtgagttcctctgtgttcagtgatgatcacgcgagtggaaacaccggcgacttccagtgctgggctcgtctccagccccaaaaccttcgatcgcgtctaaatcgagcaccggtcgtgtatatactgtctgatggcgcgaggcgaggcgcgatacg

SEQ ID NO: 791107 - DNA, 570 bp, Homo sapiens
  misc_feature: 23873.44.36.D03.1.pb.heavy.1.raw 23873
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccagtagtcaaaagaacttctttcttgcttgtcctctaccggtctcgcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccagggcctgtcacacacagtgaatgtcgtagctggcgaaggtgtatccagagctttgcaggagaccttcactgaggccatggacgctggcaacaggagagtcatcagaagctgggtcccaagagagatcgtgacgcagctaaatcgagcaccggtcgtgtatatactgtctgatgcgcgagggaggcgatacg

SEQ ID NO: 791108 - DNA, 713 bp, Homo sapiens
  misc_feature: 23914.44.55.E11.1.pb.heavy.1.raw 23914
cgtatcgcctccctcgcgccatcagacagtatatacacgaccggtgctcgatttagcactcgcacgttgggtttgggggggagaggagcccagcactgggattccgaggtggtttccattcggtgatcagcactgaacacagaggactcaccatggagttttggctgagctgggttctccttgttggacttttaaaaggtgtccagtgtgaggtgcggctgatggagtctggaggaggcttagtccagcctgggggggtcccagagactctcctgtgcagcctctgggctcaccgtcagccagcaactacatgagttgggtccgcccaggctccagggaaggggctggagtgggtctcagtcatttatactggtgatttcacatactacgcagactccgtgaagggccgattcaccatctccagggacaattccagggacacggttttatcttcaaatgaacaaccttgagaggcgacgacacggccgtctattactgtgcgagacaaagtcggcgctcggagtggttattattcgtttgacttctggggccagggaaccctggtcaccgtcgcctccgcctccaccaagggccatcggtcttccccctggcaccctcctccaagagcacctctgggggcacagcgggccctgggctgcctggtcaaggactacttcctatatactgtctgagcgggctggcaaggcgcatag

SEQ ID NO: 791109 - DNA, 687 bp, Homo sapiens
  misc_feature: 23915.UNK.UNK.UNK.pb.heavy.1.raw 23915
cgtatctcgcccctcgcctcgcgccaatttcagacgaatcaacagtatatacacgacgaccggtgctccgatttagtgctatagacttgggtttttggggatggctttctgagagtcaaggacctcctgtgcaagaacatgaagcacctgtggtttttctcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggaggggaatggagtggattggtgacatccattatactggggcgacgtactactctccgtccctcaagagtcgtctcaccatttcgagggacacgtccatgaaccgcttctccctggaaactgacctccgtggaccgccgcggacacgggccgtttattttctgtgcgaggcgagactggtctttcaatctatggggcccgtggcaccctggtcactgtctcctcagcttccaccaagggcccatcggtccttccccctggcgccctgctccaggagcaccctctggggccacagcggccctgggctgcctggtcaaggactacttcctatatactgtctgagcggggctggcaaggcgcatag

SEQ ID NO: 791110 - DNA, 635 bp, Homo sapiens
  misc_feature: 23921.UNK.UNK.UNK.pb.heavy.1.raw 23921
ctatgcgccttgccagcccgctcagacagtatataggaagtagtccttgaccaggtgcagccccaagggccgctgtgccccccagagtgctccctggagcagggcgccagggggaagaccgatgggcccttggtggaagctgaggagaacagtgaccagggtgccacggccgccatagattgaaagaccagtcctcgcctcgcacagaaataaacggccgtgtccgcggcggtcacggaggtcagttcagggagaagcggttcatggacgtgtccctcgaaatggtgagacgactcttgaggacggagagtgacgtcgccccagtataatggatgtcaccacaatccactccatgtcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaaccacaggtgttcacacgcctgcccccaatccctaatcacgtgtactaaatcgagcacccggtcgtcgtatatactgtctgatggcgcgagggaggcgatacg

SEQ ID NO: 791111 - DNA, 734 bp, Homo sapiens
  misc_feature: 23922.44.33.C11.1.pb.heavy.1.raw 23922
ctatgcgccttgccagcccgctcagacagtatataggaagtagtccttgaccaggcagcccagggccgctgtgcccccagaggtgctcttggaggagggtgccagggggaaagaccgatgggcccttggtggaggctgaggagacggcgaccgtggtcccttggcccaggcgtccataccattggagtagagcatgtcatatctgtatccacgagccccatctctcgcacagtagtagacagccgtgtcctcggctctcaggctattcatttccagatatagtgtgttcttcgaattgtctctggagattggtgaaatcggcccttcacggaatctacataatatttattacttccatcataccatataagtgccacccactccagtccctttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaaactccatggtgagttcctctgtgttcggtggctgatcaccgaactggaaacaccgccgacttctggtgctgggcttcctctcccagccccaaacccaacgagctcactctaaatcgagcaccggtcgtgtatatactgtctgatggcgcgagggaggcgatacg

SEQ ID NO: 791112 - DNA, 583 bp, Homo sapiens
  misc_feature: 23927.44.78.H01.1.pb.heavy.1.raw 23927
ctatgcgccgccttgccagcccgctcagacagtatataggaagtagtcttgaccaggcagcccagggtccgcgtgctctccggcgtctctgagttggcggcagggggaaagaccgcatgggcccttggctgaggctgcaggagaacggtgaccaggttccctggccccacaagtcaagccaggtgcggggctccgcacagaatacacggtgtctcagatctcagctgctcagttccatgtagctgtacctggggaggtgctcctggtcatactaactctgccttggaacttctgggcaaagcccgtgttgccactatagggcttcatccattcccatccactccagcccttgtccagcggcctgtcgcacccagttaatatcataattgatgacgtgtatccagaagccgtgccaggagactgtcactgaggccccaggcttcttcacctcagccccagactgcaccagctgtacctgggagtgggaccgtcagtcttcctcttcccccaaacccaaactactcacactaaatcgagcaccggtcgtgtatatactgtctgatggcgcgagggaggcgatacg

SEQ ID NO: 791113 - DNA, 619 bp, Homo sapiens
  misc_feature: 23931.UNK.UNK.UNK.pb.heavy.1.raw 23931
cccggacacgcttgctagggacttggagcctaaggacgacatattgcctttagacagtcgaaggtgacgccttagctaccactggaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggatagggaaaatagaatccacccctatcacccccccaccatagcctgcttgggtgttgagtttacttttatttcgtgttggaatgagttgaacttccgggaagtggagtaatgggtttgtctacttcccctaaccgcaaagtactagtttacgagtgggcgttgcaagccatagccagtcacagggtaataaacaattcaacgtggcgtaaagattggccggcttgctgtgggcatttgccaagggctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 791114 - DNA, 723 bp, Homo sapiens
  misc_feature: 23942.UNK.UNK.UNK.pb.heavy.1.raw 23942
ctatgcgccttgccagccccgctcagacagtatataggaagtagtccttgaccaggcagcccagggccgctgtgcccccagaggtgctcttggaggagggtgccaggggaagaccgatgggcccttggtggaggctgaggagacggcgaccgtggtcccttggcccaggcgtccataccattggagtagagcatgtcatatctgtatccacgagccccatctctcgcacagtagtagacagccgtgtcctcggctctcaggctattcatttccagatatagtgtgttcttcgaatgtctctgagatggtgatcggccttcacggaatctacataatatttattacttccatcataccatataagtgccacccactcagtcccttgcctggagcctggcggacccagtgcatgccatgtctgttgaaggtgaatccagacgctacacaggagagtctcagggacctcccaggctggaccacgcctccccagactccaccagcttcacctgacactggacacctcttaaaagagcaacgaggaaaaacccaggtcagcccaaactccatggtgagtcctctgtgttcggtgctgatcaccgactggaaacaccgccgacttctggtgctgggctcctctcccagagctccccaaacccaacgagctcactctaaatcgagcaccgtcgtgtatatactgtctgatggcgcgagggaggcgatacg

SEQ ID NO: 791115 - DNA, 702 bp, Homo sapiens
  misc_feature: 23945.44.55.E11.1.pb.heavy.1.raw 23945
ctatgcgccttgccagcccgctcagacagtatataggaagtagtccttgaccaggcagcccagggccgctgtgcccccagaggtgctcttggaggagggtgccaggggaagaccgatgggcccttggtggaggcggaggcgacggtgaccagggttccctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttcctggagcctggcggacccaactcatgtagttgctgctgacggtgagcccagaggctgcacaggagagtctctgggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgagggaggcgatacg

SEQ ID NO: 791116 - DNA, 681 bp, Homo sapiens
  misc_feature: 23971.44.45.E01.1.pb.heavy.1.raw 23971
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggctccctggccccagtagaacgatgggctcgtacataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcagggacgtcccaggctggaccacgcctcccccagactcaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 791117 - DNA, 611 bp, Homo sapiens
  misc_feature: 23983.UNK.UNK.UNK.pb.heavy.1.raw 23983
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaaacccattactccacttcccggaagttcaactcattccaacacgaaataaaagtaaaactcaacacccaagcaggctatgtgggggggtgataggggtggattctatttcctatcccatccccctaggatctcaattaagttactagcgagttaaatgtctgtagcgatcccgtcagtcctatcgcgcgcatcaagacctggttggttgagccgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 791118 - DNA, 664 bp, Homo sapiens
  misc_feature: 23990.UNK.UNK.UNK.pb.heavy.1.raw 23990
cgtatcgcctccctcgcgccatcagacagtatatacacggaccggtgctcgatttagatctactgacaaccacattcctcctctaaagaagcccctgggagcacagctatcaccatggactggacctggaggttcctctttgtggtggcagcagcacaggtgtccagtcctggtgcaaactggtgcagtctgggactagaatgccgcaacctggtcctcgtgaccctttcctgcacggctctggaagtactaccagttccactacttataccatcaaactgggtgcgccaggcccctggacaagggcttgagtggatgggtggaatcatccctcttttggctcactcacctacgcacgagacttccgggcagaattacgatttaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcactcagcttccaccaagggcccatcgtcttccccctggcgccctgctccaggagcacctctgggggcacagcggccctggctgcctggtcaagactacttcctatactgtctgagcggctggcaaggcgcatag

SEQ ID NO: 791119 - DNA, 692 bp, Homo sapiens
  misc_feature: 24003.44.73.G07.1.pb.heavy.1.raw 24003
ctatgcgccttgccagcccgctcagacagtatataggagtagtccttgaccaggcagcccagggccgctgtgctctcggaggtgctcctggagcagggcgccaggggaagaccgatgggcccttggtggaggctgaggagacggtgaccagggttccctggccccagtagtcaagcggggaccgtctcgagggggctctcgcacaataaatagacagccgtgtcctcacttgtgaggttgtacatttgcagatgcagtgtgttcctggaattgtctctggagacggtgaatcggcccttctcggagtctccgtagtgttcttcaattccatcttctgatataattgccacccactccagccccttgcctggagcctggcggacccagtgcatggcataggtcctgaagatgaatccagaggctgcacaggagagtctcagggagttcccaggctgggccgctcctcccccagactccactagctgcacctgacactggccacctcttaaaagagcaacgaggaaaaacccatctcagcccaaagtccatggtgagtcctctgtgttcagtgatgatcaccgaatggaaacaccggcgacttccagtgctgggctcgtctccccccctgagcgtagagctaaatcgagcaccggtcgtgtatatactgtctgatggcgcgagggaggcgatac

SEQ ID NO: 791120 - DNA, 651 bp, Homo sapiens
  misc_feature: 24012.44.86.H09.1.pb.heavy.1.raw 24012
ctatgcgccttgccagcccgctcagacagtatataggaagtagttccttgaccaggcagcccagggccgctgtgcccccagaggtgctcctggagcaggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcgttcatggacgtgtccctcgaaatggtgagacgactcttgaggacggagagtagtacgtcgccccagtataatggatgtcaccaatccactccattccctccctggggggctgccggatccagccccaagaaatgatcagaactgatggaaactccagagacagtgcagatgagagacagggttcccgaaggcctcaccagtcctgggcccgactcctgcagctgcacctgggacaggacccatctgggagctgccaccagcaggaggaaaaacacaggtgcttcatgttctgcacaggaggtccttgactctcagaaagcatcccaaacccaagtctatagcactaaatcgagcaccggtcgtgtatatactgtctgatggcgcgagggaggcgatacg

SEQ ID NO: 791121 - DNA, 565 bp, Homo sapiens
  misc_feature: 24050.44.78.H01.1.pb.heavy.1.raw 24050
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggcccacaagtcaagccaggtgctggtggctctcgcacagaaatacacggccggtgcctcagatctcaggctgctcagttccatgtagactgtacctggggaggtgctcctggtcatactaactctgccttggaactctgggcaaagcccgtgttgccactatagggctcatccatcccatccactccagcccttgtccagcgcctgtcgcaccagttaatatcataattgatgaacgtgtatccagaagccgtgcaggagactgtcaactggaggccccaggcttcttcacctcagcagcgtggtgaccgtgacctccagcaactcggcacccaaacccaaactactcacactaatcgagcaccggtcgtgtatatactgtcgatgcgcgagggggcgatacg

SEQ ID NO: 791122 - DNA, 730 bp, Homo sapiens
  misc_feature: 24052.44.86.H09.1.pb.heavy.1.raw 24052
ctatgcgccttgccagcccgctcagacagcttataggaagtagtccttgaccaggcagcccagggccgctgtgccccagaggtgctctgagagggtgccagggggaagacgatggcccttggtggaggctgaggagacggcgaccgtggtccctttggccccaggcgtccataccattggagtagagcatgtcatatctgtatccacgagccccatctctcgcacagtagtagacagccgtgtcctcggctctcaggctattcatttccagatatagtgtgtttttcttcgaattgtctctggagatggtgaatcggccctttcacgatctacataatatttattacttccatcataccatataagtgccacccactccagtcccttgcctggagcctggcggaacccagtgcatgccatgtctgtttgaaggtgaatccagacgctacacaggagagtctcagggaccttcccaggctggaccacgcctccccagactccaccagcttcacctgacactggacacctcttaaaagagcaacgaggaaaaacccaggtcagcccaaactccatggtgagtcctctgtgttcggtgctgaatcaccgactggaaacaccgccgacttctggtgctgggctcctctcccagagctccccaacccaagtctatagcactaaatcgagcaccggtcgtgtatatactgtctgatggcgcgagggaggcgatacg

SEQ ID NO: 791123 - DNA, 654 bp, Homo sapiens
  misc_feature: 24078.44.86.H09.1.pb.heavy.1.raw 24078
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaaggccttcgggaaccctgtctctcatctgcactgtctctggagtttccatcagttctgatccattcttggggctgggatcggcagccccagggaggggaatggagtggaattggtgacatccattatactggggcgacgtactactctccgtccctcaagagtcgtctcaccatttcgaggacacgtccatgaaccgcttctccctgaaactgacctccgtgaccgccgcggacacggcgtttatttctgtgcgaggcgagactggtctttcaaatctatgggccgtggcaccctggtcactgtctcctcagctttccaccaaggccccatcggtcttccctgggcgccctgctccaggagcacctctgggggcacagcggccctgggctgcctggtcaaggactacttcctatatactgtctgagcgggctgcaaggcgcatag

SEQ ID NO: 791124 - DNA, 697 bp, Homo sapiens
  misc_feature: 24080.UNK.UNK.UNK.pb.heavy.1.raw 24080
cgtatcgcctccctcgcgccatcagacagtatatacacgaccgtgctcgattagcactcgcacgttgggttttgggggggagaggagccccagcactgggatttccgaggtgtttccattcggtgatcagcactgaacacagaggactcaccatggagttttggctgagctggttctccttgttggactttaaaaggtgtccagtgtgaggtgcggcctgatggagtctggaggaggcttagtcagcctggggggtcccagagactctcctgtgcagcctctgggctcaccgtcagcagcaactacatgagttgggtccgcaggctccgggaaggggctggagtgggtctcagtcatttatactggtgattcagcatactacgcagactccgtgaagggccggattcaccatctccagggacaattccaggaacacggttatcttcaaatgaacaacctgagaggcgacgacgacggccgtctattactgtgcgagacaagtcggcgctcggagtggttattattcgtttgacttctggggccagggaccctggtcaccgtcgcctccgcctccaccaaggcccatcggtcttcccctggcaccctcctccaaggcacctctgggggcacagcggccctggctgcctgtcaagactacttcctatatactgtctgagcgggctggcaaggcgcatag

SEQ ID NO: 791125 - DNA, 728 bp, Homo sapiens
  misc_feature: 24108.44.33.C11.1.pb.heavy.1.raw 24108
ctatgcgccttgccagcccgctcagacagtatataggaagtagtccttgaccaggcagcccaggggcgctgtgcccccagaggtgctcttggggagggtgccagggggaagaccgatgggcccttggtggaggctgaggagacggcgaccgtggtcccttggccgcagggcgtccataccattggagtagagcatgtcatatctgtatccacgagccccatcctctcgcacagtagtagacagccgtgtcctcggctctcaggctattcatttccagatatagtgtgttcttcgaattgtctctggagatggtgaatcggccttcacggaatctacatatatttattacttccatcatacgcatataagtgccacccactccagtcccttgcctggagcctggcggacccagtgcatgcccatgtctgtgaaggtgaatccagacgctacacaggagagtctcaggacctcccaggctggaccacgcctccccagactccaccagcttcacctgacactggacacctcttaaaagagcaacgaggaaaacccaggtcagcccaaaactccatggtgagtccctctgtgttcggtgctgatcaccgactggaaacaccgccgacttctggtgctgggctcctctcccagagctccccaaacccaacgagctcactctaaatcgagcaccggtcgtgtattactgtctgatggcgcgaggaggcgatacg

SEQ ID NO: 791126 - DNA, 727 bp, Homo sapiens
  misc_feature: 24141.UNK.UNK.UNK.pb.heavy.1.raw 24141
ctatgcgccttgccagcccgctcagacagtatataggaagtagtcttgaccaggcagcccagggccgctgtgcccccagaggtgctcctggagcagggcgccaggggaagaccgatgggcccttggtggaagctgaagagacggtgaccattgtccctggccaaaatatcaaatgcatcgacgtcccaggatcgcctggcgcccagtaatagacgcctgtgtgtcgtcgggtctcaggttgctcattgtaaagtggcccaacactgttggagtcatcccttgagacggtgaatcttcccttcacaggacgcggcgtactctttacttccaccataacgttttcattctgacgaaagtgatccactcaagcccccttccctggagcctgacggacccaggccaagtgataatcactaagactgaatcctgagactacacaggagagtctcagagaccgccctggctgtgccaagccccccccccccgactccgccagtcgccctcgcactggacaccttctaaaaaaaactacaaggaaaatcaagatttagcccaaaactcccatggttgggtggtctgtgctcagtgctgatcaccaagtggaaactccgtggaatctcacggctggggctcctctcccagagctcccctttgtgtgttcagagtctgctaaatcgagcaccggttcgtgtatatactgttctgatggcgcgagggaggcgatacg

SEQ ID NO: 791127 - DNA, 687 bp, Homo sapiens
  misc_feature: 24194.44.71.G05.1.pb.heavy.1.raw 24194
ctatgcgccttgccagcccgctcagacagtatataggaagtagtccttgaccaggcagcccaggccgctgtgccccagaggtgctcctggagcagggcgccaggggaagaccgatgggcccttggtggaagctgaagagacggtgaccattgtcccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccagcccccccgactccgccagtcgcccctcgcactggacaccttctaaaaaactacaaggaaaatcagattagcccaaactccatggttggtggtctgtgctcagtgctgatcaccaagtggaaactcctggaatctcacggctggggctcctctctcttgcgacgacactaaatcgagcaccggtcgtgtatatactgtctgatggcgcgagggaggcgatacg

SEQ ID NO: 791128 - DNA, 697 bp, Homo sapiens
  misc_feature: 24253.44.74.G08.1.pb.heavy.1.raw 24253
cgtatcgcctccctcgcgccatcagacagtatatacacgaccggtgctcgatttagtagctctatcaggggagcatcacataacaaccacattcctcctctaaagaagcccctgggagcacagctcatcaccatgactggacctggaggttcctctttgtggtggcagccagcaaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccggggcagaattacgattaccgcggacaagtccacagacacagtctccatgacaatgagttctttgaaatccgacgacaccggccgtctactactgtgcgagaggtccgtaccccagctcgcatggagcctttgagatctgggggcagggaaccctggtcattgtcaacctcagcttccaccaagggcccatcggtcttcccctggcgccctgctccaggagcacctctgggggcacagcggccctgggctgcctggtcaagggactactttcctatatactgtctgagcgggctggcaaggcgcatag

SEQ ID NO: 791129 - DNA, 714 bp, Homo sapiens
  misc_feature: 24293.44.85.H08.1.pb.heavy.1.raw 24293
cgtatcgcctccctcgcgccatcagacagtatatacacgaccggtgctcgatttagtatcactcagtcgcgggagctctgggagaggagcccagcactagaagtcggcggtgtttccattcggtgatcagcactgaacacagaggactcaccatggagtttgggctgagctgggttttcctcgttgctctttaagaggtgtccagtgtcaggtgcagctggtggagtctggggaggcgtggtccagcctggaggtccctgagactctcctgtgcagcgtctggattcaccttcagtacctatggcatgcactgggtccgccaggctccaggcaagggctggagtggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaaggaccacggtcaccgtctcctcagcctccaccaagggcccatcggtcttccccctggcaccctctccaagagcacctctggggcacagcggccctgggctgcctggtcaaggactacttcctatatactgtctgagcgggctggcaaggcgcatag

SEQ ID NO: 791130 - DNA, 1401 bp, Homo sapiens
  misc_feature: 24294.44.56.F01.1.pb.heavy.1.raw 24294
cgtatcgcctccctcgcgccatcagacagtatatacacgaccggtgctcgattttagcagacgtctgaacacacaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgactggcggagtcggggggggcttggcacagccagggcggtctctgagactctcctgtgtagtctcaggattcagtctagtgattatcacttggcctgggtccgtcaggctccagggaaggggcttgagtggatcactttcgtcagaatgaaacgttatggtggaagtaaagagtacgccgcgtctgtgaagggaagattcaccgtctcaagggatgactccaacagtgttggccatttacaatgagcaacctgagacccgacgacacaggcgtctattactgcgccaggcgatcctgggacgtcgatgcatttgatatttggggccaggggacaatggtcaccgtctcttcagcttccaccaagggcccatcggtcttccccctggcgccctgctccaggagcacctctgggggcacagcggccctgggctgcctggtcaaggactacttcctatatacttctgagcggctggcaaggcgcatagcgtatcgcctccctcgcgccattcagacagtatatacacgaccggtgctcgatttagctgcgtcacgatctctcttggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccaggaaggggctggagtgcttggccgcagtaaaacaaagttgccagctttatcacagagtacgccgcgtctgtgaagccagattcaccctctcaagagatgacttcaagaactcattgattctgcgaatgactaacctgaaaaccgaggacacgggcatgtattattgtgttgtgtttatatcaggaactgtccactgggccagggaaccctggtcaccgtctcctcagcctccaccaagggcccatcggtcttccccctggcgccctgctccaggagcacctccgagagcacagcggcctgggctgcctggtcaaggactacttcctatatactgtctgagcgggctggcaaggcgcatag

SEQ ID NO: 791131 - DNA, 707 bp, Homo sapiens
  misc_feature: 24316.44.67.G01.1.pb.heavy.1.raw 24316
ctatgcgccttgccagcccgctcagacagtatataggaagtagtccttgaccaggcagcccagggccgctgtgcccccagaggttgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaaccgtgtttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggacccccaggctggactaagcctcctccagactccatcagccgcacctcacactggacaccttttaaagtccaacaaggagaacccagctcagccaaaactccatggtgagtcctctgtgttcagtgctgatcaccgaatggaaacacctcggaaatcccagtgctgggctcctctcccccccaaacccaatatgtatactctaaatcgagcaccggtcgtgtatatactgtctgatggcgcgagggaggcgatacg

SEQ ID NO: 791132 - DNA, 618 bp, Homo sapiens
  misc_feature: 24319.44.38.D05.1.pb.heavy.1.raw 24319
cgtatcgcctccctcgcgccatcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 791133 - DNA, 723 bp, Homo sapiens
  misc_feature: 24324.44.33.C11.1.pb.heavy.1.raw 24324
cgtatcgcctcctcgcgccatcagacagtatatacacgaccggtgctcgatttagagtgagctcgttggtttggggctgggagaggagcccagcaccagaagtcggcggtgtttccagtcggtgatcagcaccgaacacagaggactcaccatggagtttgggctgacctggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 791134 - DNA, 732 bp, Homo sapiens
  misc_feature: 24325.UNK.UNK.UNK.pb.heavy.1.raw 24325
cgtatcgcctccctcgcgccatcagacagtatatacacgaccggtgggctcgatttagtatcactcagtcgcggggagctctgggagaggagcccagcactagaagtcggcggtgtttccattcggtgatcagcactgaacacagaggactcaccatggagtttgggctgagctgggttttcctcgttgctctttaagaggtgtccagtgtcaggtgcagctggtggagtctgggggagggcgtggtccagcctgggaggtccctgagactctcctgtgcaggcgtctgattcaccttcagtacctatggcatgcactgggtccgccaggctccaggcaaggggctggagtgggtggcactttatatggtattgatggaagtaataaatactatgcagactccgtgaagggccgattcaccatctccagagacaattccaagaaacacgctgtatctgcaaaatgaacagcctgagagccgaggacacggctgtgtattacttgtgcgaggacatattgtagtactaccacctgctgggactactactacggtatggacgtctggggccaagggaccacggtcaccgtctcctcagcctccaccaagggcccatcggtcttccccctggcaccctcctccaagaggcacctctggggcacagcggcctggcctggcctgcggtcaaggactacttcctatatactgtctgagcgggctggcaaggcgcatag

SEQ ID NO: 791135 - DNA, 655 bp, Homo sapiens
  misc_feature: 24336.44.12.B01.1.pb.heavy.1.raw 24336
cgtatcgcctccctcgcgccatcagacagtatatacacgaccggtgctcgatttagtagtgtagattccgcggggctttctgagagtcatggacctcctgtgcaagaacatgaagcacctgtggttcttcctcctgctgtggcggctcccagatgggtcctgtccagctgcagctgcaggagtcgggcccaggactggtgaagccttcggagaccctgtccctcacctgcactgtctctggtggctccatcagcagtagtagttactactggggctggatccgccagcccccagggaagggctggagtggattgggagtatctatatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactacttgaccactgggccagggaacctggtcaccgtctcctcagcctccacaagggcccatcggtcttccccctggcaccctcctccaagagcacctctgggggcacagcggcctgggctgcctggtcaaggactacttcctatatactgtctgagcgggctggcaaggcgcatag

SEQ ID NO: 791136 - DNA, 645 bp, Homo sapiens
  misc_feature: 24365.44.23.C01.1.pb.heavy.1.raw 24365
aatgcgccttttgccagcccgctcagacaggtatataggaagtagtccttgaccaaggcagcccagggccgctgtgcccccagaggtgctcctggagcagggcgccagggggagaccgatgggcccttggtggaagctgaggagacagtgaccagggtgccacggccccatagatgaaagaccagtctcgcctcgcacagaaataacggccgtgtccgcggcggtcacggaggtcagttcaggggaagcggttcatggacgtgtccctcgaaatggtgagacgactcttgagggacggagagtagtacgtcgccccagtataatggatgtcaccaatccactccattccctccctgggggctgccggatccagccccaagaatgatcagaactgatggaaacccagagacagtgcgatgagagacagggttcccgaaggcctcaccagtcctgggcccgactcctgcagctgcacctggacaggaacccatctgggagctgccaccagcaggaggaaaaaccacaggtgcttcatgttcttgcacaggaggtccttgactctcagaaagccccaatccctaatcacgtgtactaaatcgagcaccggtcgtgatatactgtctgatggcgcgagggggcgatacg

SEQ ID NO: 791137 - DNA, 668 bp, Homo sapiens
  misc_feature: 24370.UNK.UNK.UNK.pb.heavy.1.raw 24370
cgtatcgcctccctcgcgccatcagacagtatatacacgacgggtgctcgatttagcacacgatagttggtttggggatactttctgagactcatgggcctcctgcacaagaacatgaaacacctgtggttcttcctcctcctggtggcacctcccagatgggtcgtgtccgaggtgcagctgcaggagtccgggcccaggacgggtgaagccttcggagacctgtccctcacctgcaatgtctctggtggttacatcagtagttattattggagttggctgcggcagtccgccggaagggactggagtggatgggcgcatctataacagtggcagcaccaactacaccccgccctcaagagtcgaggttcaccatgtcactagacagtccaagaaccagttctccctgaaattgacttctgtgaccgccgcgacacggccgtatattattgtgcgagagattcctatcgatacagtagagacggggggggcgaactggctcgaccctggggccaggaacctggtcaccgtctcctcagcctccaccaaggcccatcggtctcccctggcaccctcctccaagagcacctctggggcacagcggccctgggctgcctgtcaaggactacttcctatatactgtctgagcgggctggcaaggcgcatag

SEQ ID NO: 791138 - DNA, 712 bp, Homo sapiens
  misc_feature: 24375.44.27.C05.1.pb.heavy.1.raw 24375
ctatgcgccttgccagcccgctcagacagtatataggaagtagtccttgaaccaggcagcccagggcccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtcctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaaacccagctcagcccaaactccatggtgagtcctctgtgttcagtgatgatcaccgagtggaaacaccggcgacttccagtgctgggctcgtctcccagggctccccaaacccttcgatcgcgtctaaatcgagcaccggtcgtgtatatactgtctgatggcgcgagggaggcgatacg

SEQ ID NO: 791139 - DNA, 705 bp, Homo sapiens
  misc_feature: 24381.44.36.D03.1.pb.heavy.1.raw 24381
ctatgcgcctgccagcccgctcagaccagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacattgccgtgtcctcggttttcaggttagtcattcgcagaaatcaatgagttcttgaaagtcatctcttgagagggtgaatctggctttcacagacgcggcgtactctgtgataaagctggcaactttgtttttactgccggccagccactccagccccttccctggagcctggcggaccagtccatatagtggtcactgatggtgaatccagaggcgacacaggagagtctcaggaccctccaggctggacaagtctcccccggactcaccaactgcacttcactctggacaccttgtaaaataacaacaaggaaaacccagctcagcccgaaactccatggtgagtcctctgtgttcagtgctgatcaccaaatgaaaacacctgggaattctggggctggggctccgctctcagagctcccccaagagagatcgtgacgcagctaaatcgagcaccggtcgtgtatatactgtctgatggcgcgagggaggcgatacg

SEQ ID NO: 791140 - DNA, 723 bp, Homo sapiens
  misc_feature: 24387.44.85.H08.1.pb.heavy.1.raw 24387
ctatgcgccttgccagcccgctcagacagtatataggaagtagtccttgaccaggcagccagggccgctgtgcccccagaggtgctcttggaggagggtgccagggggaagaccgatgggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctcccccagactccaccagctgcacctgacactggacacctcttaaaagagcaacgaggaaaacccagctcagcccaaactccatggtgagtcctctgtgtttcagtgctgatcaccgaatggaaacaccgccgacttctagtgctgggctcctctcccagagctccccgcgactgagtgatactaaatcgagcaccggtcgtgtatatactgtctgatggcgcgagggaggcgatacg

SEQ ID NO: 791141 - DNA, 679 bp, Homo sapiens
  misc_feature: 24429.UNK.UNK.UNK.pb.heavy.1.raw 24429
ctatgcgccttgccagccgctcagacagtatataggaagtagtccttgaccaggcagcccaggccgctgtgctctcggaggtgctcctggagcagggcgccagggggaagaccgatgggcccttggtgaggctgaggagacggtgaccagggttccctgacccagtagtcaatgagccacccagcgcctcccgcacataatacacagccgtgtcctcgactctccagacgtttcattgcagatacagtgagttctggcgttgtctctggagatggtgaatcggcccttcacagagtccacatagtgtgtctcagttccatctttcttcatgatggccacccactccagccccttccctggagcctggcggacccagttcatccaataactactaaggtgaatccagaggctgcacagggagagtctcaggacccccaggctggaccaagcctccccagactccaccagttgcacctcacactggacaccttctaaaatagcaacaggaaaccagctcagtcccaattccatggtgagtcctctgtgctcagtgctgatcaccaagtggaaaggccttggagtccagggctaaggctcctctctcccctttccttgccagtcgtagctaaatcgagcaccggtcgtgtatatacgctgatggcgcgagggaggcgatacg

SEQ ID NO: 791142 - DNA, 704 bp, Homo sapiens
  misc_feature: 24449.44.27.C05.1.pb.heavy.1.raw 24449
ctatgcgccttgccagcccgctcagacagtatataggaagtagtgccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgatttggaaacagatagtctcgcacaaaaatacacggccgtgtcctgaggtctcaggctgttcattgaagagacactgtgttctcggaattgtctctggagatggtgaatcggccctcaacggaatcaccgtagacttgatttcctccatgaaatgacacacctgccacccactccagcccctcgcctggagcctggcggaccactgcatattccaattatcgaaggtgaatccagaggctgcacaggagagtctcagggacccccctactgggccacgcctccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagggctccccaaacccttcgatcgcgtctaaatcgagcaccggtcgtgtatatactgtctgatggcgcgagggaggcgatacg

SEQ ID NO: 791143 - DNA, 622 bp, Homo sapiens
  misc_feature: 24471.44.23.C01.1.pb.heavy.1.raw 24471
cgtatcgcctccctcgcgccatcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcgccctgggctgcctggtcaaggactacttcctatatactgtctgagcgggctggcaagggcgcatag

SEQ ID NO: 791144 - DNA, 696 bp, Homo sapiens
  misc_feature: 24472.44.55.E11.1.pb.heavy.1.raw 24472
cgtatcgcctccctcgcgccatcagacagtatatacacgaccggtgctcgatttagcactcgcacgttgggtttggggagaggagcccagcactgggattccgaggtgtttccattcggtgatcagcactgaacacagaggactcaccatggagtttggctgagctgggttctccttgttggacttttaaaaggtgtccagtgtgaggtgcggctgatggagtctggaggaggcttagtccagcctggggggtccagagactctcctgtgcagcctctggctcaccgtcagcagcaactacatgagttgggtccgccaggctccagggaaggggctggagtgggtctcagtcatttatactggtgatttcacatactacgcagactccgtgaaggccgattcaccatctccagggacaattccaggaacacggtttatcttcaaatgaacaacctgagaggcgacgacacggccgtctattactgtgcgagacaagtcggcgctcgagtgttattattcgtttgacttctggggccaggaaccctggtcaccgtcgcctccgcctccaccaagggcccatcggtcttccccctgggcacctcctccaagagcacctctgggggcacagcggccctgggctgcctggtcaaggactacttcctatatactgtctgagcgggctggcaaggcgcatag

SEQ ID NO: 791145 - DNA, 694 bp, Homo sapiens
  misc_feature: 24621.44.55.E11.1.pb.heavy.1.raw 24621
ctatgcgccttgccagcccgctcagacagtatataggaagtagtccttgaccaggcagcccaggccgctgtgccccagaggtgctcttggaggagggtgccaggggaagaccgatgggccctttggtggaggcggaggcgacggtgaccagggttccctggcccagagtcaaacgaataataaccactcgagcgccgacttgtctcgcacagtaatagacggccgtgtcgtcgcctctcaggttgttcattgaagataaaccgtgttcctggaattgtccctggagatggtgaatcggcccttcacggagtctgcgtagtatgtgaaatcaccagtataaatgactgagacccactccagcccttccctggagcctggcggacccaactcatgtagttgctgctgacggtgagcccagaggctgcacaggagagtctctggacccccccaggctggactaagcctcctccagactccatcagccgcacctcacactggacaccttttaaaagtcaacaaggagaacccagctcagccaaaactccatggtgagtcctctgtgttcagtgctgatcaccgaatggaaacacctcggaatccagtgctgggctcctctccccaaacccaacgtgcgagtgctaaatcgagcaccggtcgtgtatatactgtctgatggcgcgagggaggcgatacg

SEQ ID NO: 791146 - DNA, 626 bp, Homo sapiens
  misc_feature: 24625.44.23.C01.1.pb.heavy.1.raw 24625
cgtatcgcctccctcgcgccatcagacagtatatacacgaccggtgctcgatttagtacacgtgattagggattgggggcagggtgaacacctgtggtttttcctcctgctggtggcagctcccagatgggtcctgtcccaggtgcagctgcaggagtcgggcccaggactggtgaggcctttcgggaaccctgtctctcatctgcactgtctctggagtttccatcagttctgatcatcattcttggggctggatccggcagcccccagggaggggaatggagtggattggtgacatccattatactggggcgacgtactactctccgtccctcaagagtcgtctcaccatttcgagggacacgtccatgaaccgcttctcctgaaactgacctccgtgaccgccgcggacacggccgtttatttctgtgcgaggcgagaactggtctttcaatctatggggccgtggcaccctggtcactgtctcctcagcttcaccaagggcccatcggtcttccccctggcgccctgctccaggagcacctctgggggcacagcggccctggctggcctggtcaaggactacttcctatatactgtctgagcgggctgggcaaggcgcatag

SEQ ID NO: 791147 - DNA, 700 bp, Homo sapiens
  misc_feature: 24626.44.36.D03.1.pb.heavy.1.raw 24626
cgtatcgcctccctcgcgccatcagacagtatatacacgaccggtgctcgatttagctgcgtcacgatctctcttgggggagagcggagcccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtgggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccctggcgccctgctcaggagcacctccgagaggcacagcggccctgggctgcctggtcaaggactacttcctatatactgtctgagcgggctggcaaggcgcatag

SEQ ID NO: 791148 - DNA, 679 bp, Homo sapiens
  misc_feature: 24655.44.73.G07.1.pb.heavy.1.raw 24655
cgtatcgcctccctcgcgcatcagacagtatatacacgaccggtgctcgatttagctctacgctcagggggggagacgagccagcactggaagtcgccgggtttccattcggtgatcatcactgaacacagaggactcaccatggactttggctgagatgggttttcctcgttgctcttttaagaggtgccagtgtcaggtgcagctagtggagtctggggaggagcggcccagcctgggaactcctgagactctcctgtgcagcctctggattcatcttcaggacctatgcatgcactgggtccgccaggctccaggcaagggctggagtgggtggcaattatatcagaagatggaattgaagaacactacggagactccgagaagggccgattcaccgtctccagagacaattccagaacacactgcatctgcaaatgtacaacctcacaagtgaggacacggctgtctattattgtgcgagagccccctcgagacggtccccgcttgactactggggccagggaaccctggtcaccgtctcctcagcctccaccagggcccatcgtcttcccctggcgccctgctccaggagcacctccgagagcacagcggccctgggctgcctggtcaaggactacttcctatatactgtctgagcgggctggcaagggcatag

SEQ ID NO: 791149 - DNA, 681 bp, Homo sapiens
  misc_feature: 24660.44.45.E01.1.pb.heavy.1.raw 24660
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcagggacgtcccaggctggaccacgctcccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 791150 - DNA, 618 bp, Homo sapiens
  misc_feature: 24672.UNK.UNK.UNK.pb.heavy.1.raw 24672
cccgacacgcttgctagggactggagctaaggacgacatattgcctttagacagtcgaggtgacgccttagctaccactgaacgttttaggcgccagatgcggtctgggcgatgaccctaactcgcagctttatcgatgatctactgccacgctcaaccaaccaggtcttgatgcgcgcgataggactgacgggatcgctacagacatttaactcgctagtaacttaattgagatcctagggatgggataggaaatagaatccacctcctatcacccccccacatagcctgcttggggtgttgagtttacttttatttcgtttggaatgagtgaacttccgggaagtggagtaatgggtttgtctacttccccctaaaccgcaaaagtactagttttacgagtggcgttgcaagccatagccagtcacaggtaaaaacaattcaacgtggcgtaaagattgggcgctgctgtggggcattgcaagctgggttgcagcattgtgcatgctagacgacaatatgaatctgcgcggacccctagtggccaagatggccgctagcggggttccgcagcttttgacctggaccaggggttgcatagcctgcccaggcctttct

SEQ ID NO: 791151 - DNA, 706 bp, Homo sapiens
  misc_feature: 24677.44.36.D03.1.pb.heavy.1.raw 24677
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggaggggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactgggggccagggaaccctggtcaccgtctcctcagcctccaccaagggcccatcgtcttccccctggcgccctgctccaggagcacctccgagagcacagcggccctgggctgcctggtcaaggactacttcctatatactgtctgagcgggctggcaaggcgcatag

SEQ ID NO: 791152 - DNA, 712 bp, Homo sapiens
  misc_feature: 24719.UNK.UNK.UNK.pb.heavy.1.raw 24719
cgtatcgcctccctcgcgccatcagacagtatatacacgaccggtgctcgatttaggctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtggcagttggtggagtccgggggagacttggtccagcctggagggtccctgagactctcctgtgtcgcctctggattcacccatcagtgaccactatatggactgggtccgccaggcctccagggaaggggctggagtgggcttggcccgcagtaaaaacaaagttgccagctttatcacagagtacgccgcgtctgtgaaagccagattcacccccttcaagagatgactttcaagaactcattgattctgcgaatgactaacctgaaaaccgaggacacgggcatgtattattgtgttgtgtttatatcaggaactgtccactggggccaggaaccctggtcaccgtctcctcagcctccaccaaggcccatcggtcttccccttggcgccctgctccaggagcacctcccgagagcacagcggccctgggctgcctggtcaaggactacttcctatatactgtctgagcgggctggcaaggcgcatag

SEQ ID NO: 791153 - DNA, 624 bp, Homo sapiens
  misc_feature: 24747.44.23.C01.1.pb.heavy.1.raw 24747
ctatgcgccttgccagcccgctcagacagtatataggaagtagtccttgaccaggcaggcccagggccggctgtgcccccagaggtggctcctggagcagggcgccagggggaagaccgatggcccttggtggaagctgaggagacagtgaccagggtgccacggccccatagattgaaagaccagtctcgcctcgcacagaaataaacgccgtgtccgcggcggtcacggagtcagtttcagggagagcggttcatggacgtgtccctcgaaatggtgagacgactcttgagggacggagagtagtacgttcgccccagtataatggatgtcaccaatccactccattcccctccctgggggctgccggatccagccccaagaatgatcagaactgatggaaactccagagacagtgcagatgagagacagggttcccgaaggcctcaaccagtcctgggcccgactcctgcagctgcacctgggaacaggacccatctgggagctgccaccagcaggaggaaaaaccacaggtgttcaccctgccccaatccctaatcacgtgtactaaaatcgagcaccggtcgtgtatatactgtctgatggcgcgagggaggcgatacg

SEQ ID NO: 791154 - DNA, 652 bp, Homo sapiens
  misc_feature: 24750.44.53.E09.1.pb.heavy.1.raw 24750
ctatgcgccttgccagcccgctcagacagtatataggagtagtccttgaccaggcagcccagggccgctgtgctctcggaggtgctcctggagcagggcgccaggggaagaccgatgggcccttggtggaggctgaggatgaggagacggtgaccgtggtcccttggccccagacgtcccaagcgtagtagaattgagacgacctgccataggcggacccatgtctgacacagtagtagacagccgtgtcggcggcggccacagaactcactttcagggaaaactgtgtcctcgacgtgtccacggatatggtgactcgaccgttgagggacgggttgtagtaggtgttcccactataatagagactcccaatccactgcagcccctctcctgggggctggcggatccagccccagtagaaattacttctgtcgatggaggcaccagagaccgtgcacgtgagggacagggtctccgaaggcttcaccagtcctgggcccgactcccgcagctgcggctgagacaggacccatctgggagccgccaccagcaggaggaaaaccacaggtgcttcccccaaacccaacacactctctctaaatcgagcaccggtcgtgatagtatagactgatggcgcgagggaggcgatacg

SEQ ID NO: 791155 - DNA, 650 bp, Homo sapiens
  misc_feature: 24757.44.86.H09.1.pb.heavy.1.raw 24757
ctatgcgccttgccagccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgaggacggagagtagtacgtcgccccagtataatggatgtcaccaatccactccattcccctccctgggggctgccgatccagccccaagaatgatcagaactgatggaaactccagagacagtgcagatgagagacaggggttcccgaaggcctcaccagtcctggcccgactcctgcagctgcacctgggacaggacccatctgggagctgccaccagcaggaggaaaaaccacagtgcttcatgttcttgcacagaggtccttgactctcagaaagcatccccaaacccaagtctatagcactaaatcgagcaccggtcgtgtatatactgtctgatggcgcgagggaggcgatacg

SEQ ID NO: 791156 - DNA, 597 bp, Homo sapiens
  misc_feature: 24775.44.78.H01.1.pb.heavy.1.raw 24775
ctatgcgccttgccagcccgctcagacagtatataggaaagtagtccttgaccagcagcccagggccgctgtgctctcggaggtgctcctggagcagggcgccagggggaagaccgatgggcccttggtggaggctgaggagacggtgaccagggttccctggccccacaagtcaagccaggtgctggtggctctcgcacagaaatacacggccgtgtcctcagatctcaggctgctcagttccatgtagactgtacctggggagggtgcctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcacttgaggccccaggcttcttcacctcagccccagactgcaccagctgtacctgggagtgggaccgtcagtcttcctcttccccccaaacccaaaactactcacactaaatcgagcaccggtcgtgtatatactgtctgatggcgcgagggaaggcgatacg

SEQ ID NO: 791157 - DNA, 694 bp, Homo sapiens
  misc_feature: 24789.44.67.G01.1.pb.heavy.1.raw 24789
ctatgcggccttgccagccgctcagacatatataggaagtagtccttgaccaggcagcccagggccgctgtgcccccagaggtgctcttggaggagggtgccaggggaagacgatgggcccttggtggaggcggaggcgacggtgaccagggttccctggccccagaagtcaaacgaataataaccatcgagcgccgacttgtctcgcacagtaatagacggcgtgtcgtcgcctctcaggttgttcatttgaagataaaccgtgttccctggaattgtcctggagatggtgaatcggcccttcacggagtctgcgtagtatgtgaaatcaccagtataaatgactgagacccactccagccccttccctggagcctggcggaccaactcatgtagttgctgctgacggtgagccagaggctgcacaggagagtctctggacccccaggctggactaagcctcctccagactccatcagccgcacctcacactggacaccttttaaaagtccaacaaggagaaccagctcagccaaaactccatggtgagtcctctgtgttcagtgctgatcaccgaatggaaacacctcggaatcccagtgctgggctcctctccccccaaacccaatatgtatactctaatcgagcaccggtcgtgtatatactgtctgatggcggcgagggaggcgatacg

SEQ ID NO: 791158 - DNA, 696 bp, Homo sapiens
  misc_feature: 24791.44.55.E11.1.pb.heavy.1.raw 24791
cgtatcgcctcctcgcgccatcagacagtatatacacgaccggtgctcgatttagcactcgcacgttgggtttggggagaggagcccagcactgggattccgagtgtttccattcggtgatcagcactgaacacagaggactcaccatggagttttggctgagctgggttctccttgttggactttttaaaaggtgtccagtgtgaggtgcggctgatggagtctggagaggcttagtccagcctggggggtcccagaagactctcctgtgcagcctctgggctcaccgtcagcagcaactacatgagttgggtccgccaggctccagggaagggctggagtgggtctcagtcattatactggtgatttcacatactacgcagactccgtgaagggccgattcaccatctccaggacaattccaggaacacggtttatcttcaaatgaacaacctgagaggcgacgacacggccgtctattactgtgcgagacaagtcggcgctcggagtggttattatttcgtttgacttctggggccagggaaccctggtcaccgtcgcctccgcctcaccaagggccatcggtcttccctggcaccctcctccaagagcacctctggggcacagcggccctgggctgcctggtcaaggactacttcctatatactgtctgaggcgggctggcaaggcgcatag

SEQ ID NO: 791159 - DNA, 696 bp, Homo sapiens
  misc_feature: 24809.44.36.D03.1.pb.heavy.1.raw 24809
cgtatcgcctcctcgcgccatcagacagtatatacacgaccggtgctcgatttagctgcgtcacgatctctctggggagctctgagagcggagccccagcccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactgggccagggaaccctggtcaccgtctcctcagcctccaccaagggcccatcggtcttccctggcgccctgctccaggagcacctccgagagcacagcggccctgggctgcctggtcaaggactacttcctatatactgtctgagcggctggcaaggcgcatag

SEQ ID NO: 791160 - DNA, 725 bp, Homo sapiens
  misc_feature: 24886.44.56.F01.1.pb.heavy.1.raw 24886
ctatgcgccttgccagcccgcgtcagacagtatattaggaaagtagtcctgaccaggcagcccagggccgctgtgcccccagaggtgctcctggagcagggcgccagggggaagaccggatgggcccttggtggaagctgaagagacggtgaccattgtcccctggccccaaatatcaaatgcatcgacgtcccaggatcgccctggcgcagtaatagacgcctgtgtcgtcgggtctcaggttgctcatttgtaaatggccaacactgttggagtcatcccttgagacgggtgaatcttcccttcacacagacgcggcgtactctttacttccaccataacgtttcattctgacgaaaagtgatccactcaagccccttccctggagcctgaacggacccaggccaagtgataatcactaagactgaatcctgagaactacacaggagagtctcagagaccgccctggctgtgccaagcccccccccgactccgccagtcgccctcgcactggacaccttctaaaaaaactacaaggaaaatcaagattagcccaaactccatggttggtggtctgtgctcagtgctgatcaccaagtggaaactcctgggaatctcacggctggggctcctctcccagagctcccctttgtgtgttcagacgtctgctaaatcgagcaccggtcgtgtatatactgtctgatggcgccgagggaggcgatacg

SEQ ID NO: 791161 - DNA, 581 bp, Homo sapiens
  misc_feature: 24894.44.78.H01.1.pb.heavy.1.raw 24894
ctatgcgccttgccagcccgctcagacagtatattggagaagtagtccttgaccaggcagcccagggccgctgtgctctcggaggtgctcctggagcagggcgccagggggaagaccgatgggcccttggtggaggctgaggagacggtgaccagggttccctgggccccacaagtcaaggccaggtgctgggtggctctcgcacagaaatacacggccgtgtcctcagatctcaggctgcctcagttccatgtagactggtacctggggaggtgctcctggtcatacttaactctggccttggaacttctggcaaagcccgtgttgccactatagggcttcatccatcccatccactccagccctttccagcggcctgtcgcacccagttaatatcataattgatgaacgtgtatccagaagccgtgcaggagactgtcactgaggccccaggcttcttcacctcagcagcgtggtgaccgtgacctccagcaacttcggcacccaaacccaaaactactcacactaaatcgagcaccggtcgtgtatatactgtctgatggcgccgaggaggcgatacg

SEQ ID NO: 791162 - DNA, 575 bp, Homo sapiens
  misc_feature: 24913.44.78.H01.1.pb.heavy.1.raw 24913
cgtatcgcctccctcgcgccatcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggctttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtattttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791163 - DNA, 726 bp, Homo sapiens
  misc_feature: 24915.44.33.C11.1.pb.heavy.1.raw 24915
cgtatcgcctccctcgcgccatcagacagtatatacacgaccggtgctcgatttagagtgagctcgttgggtttggggctgggagaggagcccagcaccagaagtcggcgcgtgtttccagtcggtgatcagcaccgaacacagaggactcaccatggagtttgggctgacctgggttttcctcgttgctcttttaagaggtgtccagtgtcaggtgaagctggtggagtctggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttcccctggcaccctcctccaagagcacctctgggggcacagcggccctgggctgcctggtcaaggactacttcctatatactgtctgagcggggctggcaaggcgcatag

SEQ ID NO: 791164 - DNA, 603 bp, Homo sapiens
  misc_feature: 24935.UNK.UNK.UNK.pb.heavy.1.raw 24935
gaaggctgggcaggctatgcaccctggtccaggtcaaaagctgcggaaccgctagcggccatcttggccactagggtccgcagattcatattgtcgtctagcatgcacaatgctgcaaacccagcttgcaatgccacagcaagcggccaatcttttacgccacgttgaattgttttattacctgtgactggctatggcttgcaacgccactcgtaaaaactagtactttgcggttaggggaagtagacaaacccattactccacttcccggaagttcaactcattccaacacgaaataaaagtaaactcaacaccccaagcaggctatgtgggggtgataggggtggattctatttcctatccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcgg

SEQ ID NO: 791165 - DNA, 667 bp, Homo sapiens
  misc_feature: 24941.44.12.B01.1.pb.heavy.1.raw 24941
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagtttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtccttccccctggcaccctcctccaagagcacctctgggggcacagcggccctgggctgcctggtcaaggactacttcctatatactgtctgagcgggctggcaaggcgcatag

SEQ ID NO: 791166 - DNA, 706 bp, Homo sapiens
  misc_feature: 24985.44.36.D03.1.pb.heavy.1.raw 24985
cgtatcgcctccctcgcgccatcagacagtatatacacgaccggtgctcgatttagctgcgtcacgatctctcttggggagctctgagagcggagcccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttgtccagcctggaggggtccctgagactctctcctgtgtcgcctctgattcaccatcagtgaccactatatggactggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattatgtgtgttgtggtttatatcaggaactgtccactggggccagggcaaccctggtcaccgtctcctcagcctccaccaagggcccatcggtcttccccctggcgccctgctccagagcacctccgagagcacagcggccctgggctggcctggtcaaggactacttccttatactgtctgagcgggctggcaaggcgcatag

SEQ ID NO: 791167 - DNA, 710 bp, Homo sapiens
  misc_feature: 24992.UNK.UNK.UNK.pb.heavy.1.raw 24992
cgtatcgcctccctcgcgccatcagacagtatatacacgaccggtggcttcgatttgcactcgcacgttgggtttgggggggagaggagcccagcactgggatccgaggtgtttccattcggtgatcagcactgaacacagaggactcaccatggagttttggctgagctgggttctccttgtggacttttaaaaggtgttccagtgtgaggtgcggctgatggagtctggagggaggcttagtccagcctggggggtcccagagactctcctgtgcagcctctggctcacccgtcagcagcaactacatgagttgggtccgccaggctccagggaaggggctggagtgggtctcagtcatttatactggtgaatttcacatactacgcagactccgtgaagggccgatttcaccatctccagggacaattccaggaacacggttttatccttcaaatgaacaacctgagaggcgacgacacggccgtcattactgtgcgagaacaagtcggccgctcggaagtggtttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgc

SEQ ID NO: 791168 - DNA, 674 bp, Homo sapiens
  misc_feature: 24998.44.6.A06.1.pb.heavy.1.raw 24998
ctatgcgccttgccagcccgctcagacagtatataggaagtagtccttgaccaggcagcccaggccgctgtgcccccagaggtgctcctggagcagggcgccagggggaagaccgatgggcccttggtggaagctgaggtgacaatgaccagggttccctgcccccagatctcaaagctccatgcgagctggggtacggacctctcgcacagtagtagacggccgtgtcgtcgatttcaaagaactcattgtcatggagactgtgtctgtggacttgtcccgcgggtaatcgtaattctgccccggaagtctccgtgcgtaggtgagtgagccaaaaagagggatgattccacccatccactcaagccctgtccaggggcctggcgcacccagttgatggtataagtagtggaactggtagtacttccagaggccgtgcaggaaagggtcaccgaggaccaaggttgcggcttctagtcccagactgcaccagttgcaccagggactggacacctgttgctgctgccaccacaaagaggaaacctccaggtccagtccatggtgatgagctgtgctcccaggggcttctttagaggaggaatgtggttgtcagtagatctaaatcgagcaccggtcgtgtatatactgtctgatggcgcgagggaggcgatacg

SEQ ID NO: 791169 - DNA, 670 bp, Homo sapiens
  misc_feature: 25047.UNK.UNK.UNK.pb.heavy.1.raw 25047
ctatgcgccttgccagccgctcagacagtatataggaagtagtccttgaccaggcagcccagggccgctgtgcccccagaggtgctcttggaggagggtgccaggggagaccgatggcccttggtggaggctgaggagacggtgaccagggttccctggccccaggggtcgcgccagttcgccccccgtcttactgtatcgataggaatctctcgacaataatacggcgtgtccgcggcggtcacagaagtcaatttcagggagactggttcttggacctgtctagtgacatcggtgactcgactcttgagggcgggttgtagttgtgctgccactgttatagatgcgcccaatccactccagtccttcccggcggactgccgcagccaactcaataataactactgatgtaaccaccagagacattgcaggtgagggacagggtctccgaggcttcacccgttcctgggcccgactcctgcagctgcacctcggacacgacccatctgggaggtgccaccaggaggaggaagaaccacaggtgtttcatgtcttgtgcaggaggcccatggagtctcagaaagtatcccccaaccccaacctatcgttgcgtaaatcgagcacccggtcgtgtatatatactgtctgatggcgcgagggaggcgatacg

SEQ ID NO: 791170 - DNA, 568 bp, Homo sapiens
  misc_feature: 25064.UNK.UNK.UNK.pb.heavy.1.raw 25064
ctatgcgccctgccagcccgctcagacagtatataggaagtagtcttgaccaggcgcccagggccgctgtgctctcggaggtgctcctggagcagggcgccaggggggaaggacccgatgggccccttggtggaggctgaggagacggtgaccagggttcctggccccacaagtcaagccaggtgctggtggctctcgcacagaaatacacggccgtgtcctcagatctcaggctgctcagttccatgtagactgtacctggggaggtgctcctggtcatactaactctgcctggaacttctgggcaaagcccgggtttgccactatagggcttcatccatcccatccactcagccttgtccagcgcctgtcgcacccagttaatatcataattgatgaacgtgtatccagaagcgtgcaggagactgtcactgaggccccaggcttcttcactcagcagcgtggtgaccgtgaccgtccagcaacttcggcacccaaacccaaactactcacactaaatcgacaccggtcgtgtatatactgtctgatggcgcgaggaggcgatacg

SEQ ID NO: 791171 - DNA, 691 bp, Homo sapiens
  misc_feature: 25072.44.36.D03.1.pb.heavy.1.raw 25072
cgtatcgcctccctcgcgccatcagacagtatatacacgaccggtgctcgatttagctgcgtcacgatctctcttggggagagcggagcccagccccagaattcccaggtgttttcatttggtgatcagcactgaacacagaggactcaccatggagttcgggctgagctgggttttccttgttgttattttacaaggtgtccagagtgaagtgcagttgtggagtccggggagacttggtccagcctggagggtccctgagactctcctgtgtcgcctctggattcaccatcagtgaccactatatggactgggtccgccaggctccagggaagggctggagtggctggccgcagtaaaaacaaagtgccagctttatcacagagtacgcgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcgtcttccccctggcgccctgctccaggagcacctccgagagcacagcggccctgggctgccctggtcaaggactacttcctatatactgtctgagcgggctggcaaggcgcatag

SEQ ID NO: 791172 - DNA, 698 bp, Homo sapiens
  misc_feature: 25075.UNK.UNK.UNK.pb.heavy.1.raw 25075
gccagcccgctcagacagtatataggaagtagtccttgaccaggcagcccagggccgctgtgcccccagaggtgctcttggaggaggtgccagggggaagacgatgggcccttggtggaggcggaggcgacggtgaccagggtttccctggccccagaagtcaaacgaataataaccactccgagcgccgacttgtctcgcacagtaatagacggcgcgtgtcgtcgcctctgcaggttgttcatttgaagataaaccgtgttcctggaattgtccctggagatggtgaatcggcccttcacggagtctgcgtagtatgtgaaatcaccagtataaatgactgagacccactccagcccttccctggagcctggcggacccaactcatgtagttgctgctgacggtgaggccagaggctgcacaggagagtctctggggaccccccggctggactaagcctcctccagactccatcagccgcaccctcacactggacaccttttaaaagtccaacaaggagaacgccagctcagccaaaactccatggtgagtcctctgtgttcagtgctgatcaccgaaatggaaacacctcggaattccagtgctgggctcctctcccccccaaacccaatatgtatactctaaatcgagcaccgtcgtgtatatactgtctgatggcgcgagggaggcgataccg

SEQ ID NO: 791173 - DNA, 650 bp, Homo sapiens
  misc_feature: 25078.UNK.UNK.UNK.pb.heavy.1.raw 25078
cgtatcgcctccctcgcgccatcagacagtatatacacgaccggtgctcgaatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctctggagtttccatcagttctgatcattctggggctggatccggcagcccccagggagggaatggagtgattggtgacatccattatactggggcgacgtactactctccgtcctcaagagtcgtctcaccatttcgagggacacgtccatgaaccgcttctccctgaaactgacctccgtgaccgccgcggacacggccgtttatttctgtgcgaggcgagactggtctttcaatctatgggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 791174 - DNA, 1289 bp, Homo sapiens
  misc_feature: 25139.44.33.C11.1.pb.heavy.1.raw 25139
ctatgcgccttgccagcccgctcagacagtatataggaagtagtccttgaccaggcagcccagggccgctgtgccccagaggtgctctggagcgaggcgccaggggaagaccgatgggcccttggtggaagctgaggagacggtacagggttccctggcccaggggtcgaccacctccgacagctgctaactttcgggatctcgcacagtaatacaccggccggtcctcagatctcagcctgctcagctagctgtaggagcctctatgtattcatggggtgttcctggtcttggtgggtggtgttccgtcatggtggactctgcgcctggatctgtgcatagcctgtgttaccactgttaagggttcatccatcccatccactcaagcccttgtccagtggcctgtcgcacccagttgatatcataattggtgaaggtgtatccagagccttgcaggagaccttcactgaggccccaggcttcttcacctcagcccctactgctagtctaatcgagcaccggtcgtgtatatactgtctgatggcgcgaggaggcgatacgctatgcgccttgccagcccgctcagacagtatataggaagtagtccttcgacaggcagccaggccgctgtgccccagaggtgctcttggaggagggtgccaagggggaagaccgatggcccttggaggctgaggagacggcgaccgtgtcccttggccccaggggcgtccataccattgagtagagcatgtcatatctgtatccacgagccccatctctcgcacagtagtagacagcgtgtcctcgcgctctcagctattcatttccagatgatagtgtgttcttcgaattgtctctggagatggtgaatcgggcccttcacggaatctacataatatttattacttccatcataccatataagtgccaccactccagtcccttgcctggagcctggcggacccagtggcatgccatgtctgttgaaggtgaatccagacgctacacaggagagtctcagggaccgtcccaggctggaccgacgctcccccagactccaccagcttcacctgacactggacacctcttaaaagagcaacgaggaaaacccaggtcaggcccaaacccatggtgaagtcctctgtgttcggtgctgatcaccgactggaaacacgcgccgacttctggtgctgggctcctctcccagagctccccaaaccaacgagctcactctaaatcgagcaccggtcgtgtatatacttgtctgatggcgcgagggaggcgatacg

SEQ ID NO: 791175 - DNA, 659 bp, Homo sapiens
  misc_feature: 25185.44.86.H09.1.pb.heavy.1.raw 25185
cgtatcgcctccctcgcgccatcagacagtatatacacgaccggtgctcgatttagtgctatagacttgggtttggggatgctttctgagagtcaaggaccctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactggtctctggagtttccatcagttctgatcattcttgggggctggatccggcagccccccagggaggggaatggagtggattggtgacatccattatactggggcgacgtactactctccgtccctcaagagtcgtctcaccatttcgagggacacgtccatgaccgcttctcccctgaaactgacctccgtgaccgccgcggacacggccgttttatttctgtgcgaggcgagactggtctttcaatctatggggccgtggcaccctggtcactgtctcctcagcttccaccaagggcccatcggtcttcccctggcgccctgctccaggagcacctctggggcacagcggccctgggctgcctggtcaaggactacttcctatatactgttctgagcgggctggcaaggcgcatag

SEQ ID NO: 791176 - DNA, 602 bp, Homo sapiens
  misc_feature: 25193.UNK.UNK.UNK.pb.heavy.1.raw 25193
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgtgaattgtttattacctgtgactggctatggcttgcaacgccactcgtaaaactagtactttgcggttagggaagtagacaaacccattactccacttccggaagttcaactcattccaacacgaaataaaagtaaactcaacacccaagcaggctatgtgggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgatagctgcgagttaggtcatcccagaccgcatctggcgcctaaacgttcagtggtagctaaggcgtcaccttcgactgtctaaaggcaatatgttcgtccttagctccaagtccctagcaagcgtgtcggg

SEQ ID NO: 791177 - DNA, 656 bp, Homo sapiens
  misc_feature: 25246.44.57.F02.1.pb.heavy.1.raw 25246
cgtatcgcctcctcgcgccatcagtctatactatcacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagttttccatcagttctgatcattcttggggctggatccggcagcccccagggagggaatggagtggattggtgacatccattatactggggcgacgtaactactctccgtccctcaagagtcgtctcaccatttcgagggacacgtccatgaaccgcttctccctgaaactgacctccgtgaccgccgcggacacggcgttttatttctgtgcgaggcgagactggtctttcaatctatggggccgtggcaccctggtcactgtctccctcagcttccaccaagggcccatcgtcttccccctggcgccctgctccaggagcacctctgggggcacagcggccctgggctgcctggtcaaggactacttcctatatactgtctgagcgggctggcaagggcgcatagg

SEQ ID NO: 791178 - DNA, 672 bp, Homo sapiens
  misc_feature: 25272.UNK.UNK.UNK.pb.heavy.1.raw 25272
cgtatcgcctccctcgcgccatcagacagtatatacacgacggtgctcgattttgatcacataacaaccacactcctcctctaaagaagccctgggagcacagctcatcaccatggactggacctggcggttcctctttgtggtggcagcagctacaggtgtccagtcccaggtgcagctggtgcagtctgggctgagtgaagaagcctgggtcctcggtgaggtctcctgcaaggcttctggaggcaccttcttcagctatgcttttatttgggtgcgacaggcccctggacaagggcttgagtggctggagggatcatccctatctttggtgcatcgaattacgcacagagtttcaggacagagtcaccattaccgcggacgaatccacgagtacagcctacatggagctgagcaggctgagatctgaagacacgccatctatttctgtgcgagagccctcgtcactttcatagtccctctcatagtcccacacatgaaattggttcgacccctgggccaggaacctgtcaccgtctcctcagctccaccaagggcccatcggtcttccctggcgcctgctccaggagcacctctggggcacagcggcctgggctgcctggtcaaggactacttcctatatactgtctgagcggctggcaaggcgcatag

SEQ ID NO: 791179 - DNA, 718 bp, Homo sapiens
  misc_feature: 25279.44.56.F01.1.pb.heavy.1.raw 25279
ctatgcgccttgccagcccgctcagacagtatataaggaagtagtccttgaccaggcagcccagggccgctgtgcccccagaggtgctcctggagcaggcgccaggggaagaccgatgggcccttggtggaagctgaagagacggtgaccattgttccctggccccaaatatcaaatgcatcgacgtccccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataaacgtttcattctgacgaaagtgatccactcaagccccttccctggagcctgacggacccaggccaagtgataatcactaagactgaatcctgagactacacaggagagtctcagagaccgccctggctgtgccaagccccccccccgactccgccagtcgcccctcgcactggacaccttctaaaaaaactacaaggaaaatcaagattagccccaaactccatggtttggtggtctgtgctcagtgctgatcaccaagtggaaactcctgggaatctcacggctggggctcctctcccagagctccctttgtgtgttcagacgtctgctaaatcgagcaccggtcgtgtatatactgtctgatggcgcgagggaggcgatacg

SEQ ID NO: 791180 - DNA, 712 bp, Homo sapiens
  misc_feature: 25311.44.73.G07.1.pb.heavy.1.raw 25311
ctatggcgccttgccagcccgctcagacagtatataggaagtagtccttgaccaggcagccccagggccgctgtgctctcggagggtgctcctggagcagggcgccagggggaagacccgatgggcccttggtggaggctgaggagacggtgaccagggttccctggccccagtagtcaagcggggacccgtcctcgagggggctctcgcacaataatagacagccgtgtcctcacttgtgaggttgtacatttgcagatgcaggtgtgttcctggaattgtctctggagacggtgaatcggccccttctcggagtctccgtagtgttcttcaattccatcttctggatataattgccaccccactcccagccccttgcctggagccctggcggacccagtgcatgggcataggtcctgaagatgaatccagaggctgcacaggagagtctcagggagttcccaggctgggccgctcctcccccagactccactagctgcacctgacactggccaccctcttaaaaggagcaacgaggaaaacccatctcagcccaaagtccatggtgagtccctctgtgttcagtgatgatccaccgaatgggaaacaccggcggacttccagtgctgggctcgtctccccccctgagcgtagagctaaatcgagcaccggtcgtgtatatactgtctgatggcgcgagggaggcgatacg

SEQ ID NO: 791181 - DNA, 636 bp, Homo sapiens
  misc_feature: 25331.UNK.UNK.UNK.pb.heavy.1.raw 25331
cgtatcgcctccctcgcgccatcagacagtatatacacgacggtgctcgatttagtgctatagacttgggtttgggatgctttctgagagtcaagacctcctgtgcaagaacatgaagcacctgtggttttctcctgctggtggcagctccagatggtcctgtccaggtgcagctgcaggagtcgggccagactggtgaggccttcgggaaccctgtctctcatctgcactgtctctggagtttccatcagttctgatcattcttgggctggatccggcagcccccagggagggaatggagtggatggtgacatccattatactgggcgacgtactactctccgtccctcaagagtcgtctcaccatttcgagggacacgtcatgaaccgcttctccctgaaactgacctccgtgaccgccgcggacacggccgtttatttctgtgcgaggcgagactggtctttcaatctatggggcgtggcaccctggtcactgtctcctcagcttccaccaagggcccatcggtcttccccctggcgccctgctccaggagcactctgggggcacagcggcctggctgcctggtcaaggactacttcctatatactgtctgagcgggctggcaaggcgcatag

SEQ ID NO: 791182 - DNA, 689 bp, Homo sapiens
  misc_feature: 25338.UNK.UNK.UNK.pb.heavy.1.raw 25338
cgtatcgcctccctcgcgccatcagacagtatatacacgaccgtgctcgatttagctgcgtcacgatctctcttgggagctctgagagcgagcccagccccagaattcccaggtgttttcatttggtgatcagcactgaacacagaggactcacatggagttcggctgagctgggttttccttgttgttattttacaaggtgtccagagtgaaagtgcagttgtggagtccggggagacttggtccagcctggagggtccctgagactctcctgtgtcgctctggattcaccatcagtcgaccactatatggactggtccgccaggctccagggaagggctggagtggcttgccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctgtcaccgtctcctcagcctccaccaagggcccatcgtctccccctggcgccctgctccaggagcacctccgagagcacagcggcctgggctgcctggtcaagactacttcctatatactgtctgagcggctggcaaggcgcatag

SEQ ID NO: 791183 - DNA, 614 bp, Homo sapiens
  misc_feature: 25342.44.23.C01.1.pb.heavy.1.raw 25342
ctatgcgccttgccagcccgctcagacagtatataggaagtagtccttgaccaggcagcccaggccgctgtgcccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaatggtgagacgactcttgagggacggagagtagtacgtcgccccagtataatggatgtcaccaatccactccattcccctccctgggggctgccggatccagcccaagaatgatcagaactgatggaaactccagagacagtgcagatgagagacagggttcccgaaggcctcaccagtcctggcccgactcctgcagctgcacctgggacaggaccatctgggagctgccaccagcaggaggaaaaaccacaggtgttcaccctgccccaatccctaatcacgtgtactaaatcgagcaccggtcgtgtatatactgtctgatggcgcgaggaggcgatacg

SEQ ID NO: 791184 - DNA, 721 bp, Homo sapiens
  misc_feature: 25347.44.85.H08.1.pb.heavy.1.raw 25347
cgtatcgcctccctcgcgccatcagacagtatatacacgaccggtgctcgatttagtatcactcagtcgcggggagctctgggagaggagcccagcactagaagtcggcggtgttttccattcggtgatcagcactgaacacagaggactcaccatggagtttggggctgagctgggttttctcgttgctctttaagaggtgtccagtgtcaggtgcagctggtggagtctgggggaggcgtggtccagcctgggaggtccctgagactctcctgtgcagcgtctggattcaccttcagtacctatggcatgcactgggtccgccaggctccaggcaagggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacgggtcaccgtctcctcagcctccaccaagggcccatcggtcttccccctggcaccctcctccaagagcacctctgggggcacagcggccctggctgcctggtcaaggactactcctatatactgtctgagcgggctggcaaggcgcatag

SEQ ID NO: 791185 - DNA, 722 bp, Homo sapiens
  misc_feature: 25348.UNK.UNK.UNK.pb.heavy.1.raw 25348
gtcatgcgctcctcactccgcgccatcagacagtatatacacgacggtgctcgatttagcagacgtctgaacacacaaaggggacgctctggggagaggagccccagccgtgagattcccaggagtttccacttggtgatcagcactgagcacagacaccaaccatggagtttgggctaatcttgattttccttgtagtttttttagaaggtgtccagtgcgaggggcgactggcggagtcgggggggggcttgctggcacaggccagagcggtctctgagactctcctgtgtagtctcaggattcagtcttagtgattatcacttgcctgggtccgtcaggctccagggaagggctcttgagtggatcactttcgtcagaatgaaacgttatggtggaagtaagagtacgccggtctggtgagggaagattcaccgtctcaagggatgactccaacagtgttggccatttacaaatgagcaacctgagacccgacgacacaggcgtctattactgcgccaggcgatcctgggacgtcgatgcatttgatatttgggggccaggggacaatggtcaccgtctcttcagcttccaccaaggccgcatcggtcttccccctggcgcctgctccaggagcacctctggggcacagcggcctgggctgcctgtcaaggactacttccgtatatactgtctgagcgggctggcaaggcgcatagatc

SEQ ID NO: 791186 - DNA, 692 bp, Homo sapiens
  misc_feature: 25379.UNK.UNK.UNK.pb.heavy.1.raw 25379
cagcccgctcagacagtatataggaaggtagtcttgaccaggcagccagggccgcctgtgcttctcggaggtgctcctggagcagggcgccagggggaagaccgatgggccccttggtggaggccggaggagacggtgaccagggttccctggccccagggcgtcgaatgaaccgatttgaaacagatagtctcgcacaaaaaaatacacggccgtgtcctgaggtctcagggctgttcatttgaagagacactgtgttctcgaattgtctctggagatggtgaatcgaccctcaacggaatcaccgtagacttgatttcctccatgaatgacacacctgccacccactccagcccctcgcctggagcctggcgaaccactgcatattccaattatcgaaggtgaatccagaggcgccacaggagagtctcagggaccccctactggggccacgcctccccagactccacgaattgcacctgacacatgaaccctctaaagagggcacgaggaaaacccagctcagcccaaactccatggtgagtcctctgtgttcagtgaatgatcaccgagtggaaacaccgggcgacttttccagtgctggctcgtctcccagccccaaacccttcgatcgcgtctaaatcgagcacccggtcgtgtatatacgtctgatggcgcgaggaggcgatacg

SEQ ID NO: 791187 - DNA, 544 bp, Homo sapiens
  misc_feature: 25394.44.38.D05.1.pb.heavy.1.raw 25394
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacggtgaccgtggtcccttggccccagacgtccataccgtagtagtagtatgcaactccccgaactcccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactatcagatactaaatcgagcaccggtcgtgtatatactgtctgatggcgcgagggaggcgatacg

SEQ ID NO: 791188 - DNA, 737 bp, Homo sapiens
  misc_feature: 25395.44.33.C11.1.pb.heavy.1.raw 25395
ctatgcgccttgccagcccgctcagacagtatataggaagtagtccttgacccaggcagcccagggccgctgtgccccccagaggtgctcttggaggagggtgccaggggggaagaccgatgggcccttggtggaggctgaggagacggcgaccgtggtcccttggccccaggcgtccataccattggagtagagcatgtcatatctgtatccacgagccccatctcctcgcacagtagtagaccagccgtgtcctcggctctcaggctattcatttccagatatagtgtgtttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagctttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagagctccccaaacccaacgagctcactctaaatcgagcaccggtcgtgtatatactgtctgatggcgcgagggaggcgatacg

SEQ ID NO: 791189 - DNA, 645 bp, Homo sapiens
  misc_feature: 25402.44.53.E09.1.pb.heavy.1.raw 25402
cgtatcgcctcctcgcgccatcagacagtaatacacgaccggtgctcgatttagagagagtgtgttgagctctgggagaggagcccccagccttgggattccaggtgtttcattcagtgatcaggacgaacacagaggactccatgggctgagctggatttccttgctgctattttaaaaggtgtccagtgtgagggcagttggggagtctgggggggggtgcctggggtcccttaattctgtgcagcctctgatttcagtaacgcctggtgatggtccgccaggctccagggaaaggggctggagtgggttggccgtattagaaccaaagctgacggtgggacagcagactaccctgcacccgtgaaaggcagattcaccatctcaaagagatgattcaaaagatacggtgtctctgcagatgaacagcctgaacaccgaggacacagccgtctattactgtctgggatggtttcattcgggccagggaaccctggtcaccgtctcctcagcctccaccaagggccatcggtcttccccctggcgccctgctccaggagcacctccgagagcacagcggccctgggctgcctggtcaaggactacttcctatatactgtctgagcgggctggcaaggcgcatag

SEQ ID NO: 791190 - DNA, 723 bp, Homo sapiens
  misc_feature: 25411.UNK.UNK.UNK.pb.heavy.1.raw 25411
ctatgcgccttgccagcccgctcagacagtataataggaagtagtccttgaccaggcagcccagggccgctgtgctctccggagggtgctcctggagcagggcgccaggggaagaccgatgggccccttggtggaggccgaggagacggtgaccaggggttccctggccccagggcgtcgaatgaaccgattttgaaacagatagtctcgcacaaaaatacacggccgtggtcctgaaggttctcaggctgttcatttgaagagacactgtgttctcggaattgtctctggagatggtgaatcggccctcaacggaatcaccgtagacttgatttcctccatgaaatgacacacctgccacccactccagccccctcgcctggagcctggcggacccactgcatattccaattatcgaaggtgaatccagaggctgcacaggagagtctcaggcgacccccccctactggggccacgccttcccccagactccacgaattgcacctgacacatgacacctcttaagaggggcaacgaggaaaccccagctcagcccaaactccatggtgagtcctctgtgttcagtgatgatcaccgagtggaaacaccggcgacttccagtgctggggctcgtctcccaggccccaaaccctttcgatcgcgttctaaatcgagcaccgggtcgtgtatatactgttctgatggcgcgagggaggcgatacg

SEQ ID NO: 791191 - DNA, 689 bp, Homo sapiens
  misc_feature: 25462.44.36.D03.1.pb.heavy.1.raw 25462
cgtatcgcctccctcgcgccatcagacagtatatacacgaccggtgctcgattagctgcgtcacgatctctcttgggagctctgagagcggagccccagccccagaattcccaggtgtttcatttggtgatcagcactgaacacagaggactcaccatggagttcgggctgagctgggttttccttgttgttattttacaaggtgtccagagtgaagtgcagtggtggagtccggggagacttggtccagcctggagggtccctgagactctcctgtgtcgcctctggattcaccatcagtgaccactatatggactgggtccgccaggctccagggaaggggctggagtggcttggccgcagtaaaaacaagttgccagcttatcacagagtacgccgcgtctgtgaaagccagattcacctctcaagagatgacttcagaactcattgattctgcgaatgactaacctgaaaaccgagggacacgggcatgtattattgtgtttgtttatatcaggactgtccactgggccagggaaccctggtcaccgtctcctcagcctccaccaagggccatcgtcttcccctggcgccctgctccaggagcacctccgagagcacagcggcctgggctgcctggtcaaggactacttcctatatactgtctgagcggctggcaaggcgcatag

SEQ ID NO: 791192 - DNA, 613 bp, Homo sapiens
  misc_feature: 25485.44.23.C01.1.pb.heavy.1.raw 25485
ctatgcgccttgccagcccgctcagacagtatataggaagtagtcctgaccaggcaggccccagggccgctgtgccagggtgctcctggagcagggcgccagggggaagaccgatgggcccttggtggaagctgaggagacagtgaccagggtgccacggccccatagattgaaagaccagtctcgcctcgcacagaaataaacggccgtgtcgcggcggcacggagggtcagtttcagagaagcggttcatgacgtgtcctcgaatggtgagacgactcttgaggggacggagagtagtacgtcgccccagtataatggatgtcaccaatccactccattcccctccctggggggctgccggatccagcccccaagaatgatcagaactgatggaaactcccagagacagtgcagatgagagacaggttcccgaaggcctcaccagtcctgggcccgactcctgcagctgcacctgggacaggacccatcgggagctgccaccagcaggagaaaaccacaggtgttcaccctgccccaatccctaatcacgtgtactaaatcgagcaccggtcgtgtatatactgtctgatggcgcgagggaaggcgatacg

SEQ ID NO: 791193 - DNA, 597 bp, Homo sapiens
  misc_feature: 25495.44.36.D03.1.pb.heavy.1.raw 25495
cgtatcgcctccctcgcgccatcagacagtatatacacgaccggtgctcgatttagctgcgtcacgatctctcttgggtcttgtcccaggtcacttgaaggagtctggtcctgtgctggtgaaacccacagagacctcacgctgacctgcaccatctctgggttctctctcaacgatattagaatgggtgtgagctggatccgtcagcccccagggaaggccctggagtgcttgcacacatcttctcgaatgacgaaaaatcctacagtacatctctgaagagcagttttaccatctccaaggacacctccaaaaggcaggtggtctttagtatgaccaacatggaccctgcggacacagcacatattactgtgcacggtaatgcgggaaagaaacagctggtttctgtattataagtcttaccatctggacgtctgggcaaagggacacggtcaccgtctcctcagcttccaccaagggaccatcggtcttcccctggcgcctgctccaggagcacctctggggcacagcggccctgggctgcctggtcaagactacttcctatatactgtctgagcgggctggcaaggcgcatag

SEQ ID NO: 791194 - DNA, 727 bp, Homo sapiens
  misc_feature: 25524.UNK.UNK.UNK.pb.heavy.1.raw 25524
cgtatcgcctcctcgcgccatcagacagtatatacacgacggtgctcgatttagagtgagctcggttgggtttggggagctctgggagaggagcccagaccagaagtcggcggtgtttccagtcggtgatcagcaccgaacacagaggactcaccatggagtttggctgacctgggttttcctcgttgctcttttaagaggtgtccagtgtcaggtgaagctggtggagtctgggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccagatggtatggacgcctggggccaagggaccacggtcgccgtctcctcagcctccaccaagggcccatcggtcttccccctggcaccctcctccaagagcaacctctggggcacagcggccctgggctgcctggtcaaggactacttccctatatactgtctgagcgggctggcaaggcgcatag

SEQ ID NO: 791195 - DNA, 691 bp, Homo sapiens
  misc_feature: 25539.44.55.E11.1.pb.heavy.1.raw 25539
cgtatcgcctccctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccaggaaaggggctggagtgggtctcagtcatttatactggtgatttcacatactacgcagactccgtgaaggccgattcaccatctccagggacaattccaggaacacggtttatcttcaatgaacaacctgagaggcgacgacacggccgtctattactgtgcgagacaagtcgcgctcgagtggttattattcgtttgactctggggccaggaaccctggtcaccgtcgcctccgcctccaccaagggcccatcggtcttcccctggcaccctcctccaagagcacctctggggcacagcggcctggctgcctggtcaaggactacttcctatatactgtctgagcgggctggcaaggcgcatag

SEQ ID NO: 791196 - DNA, 652 bp, Homo sapiens
  misc_feature: 25552.44.71.G05.1.pb.heavy.1.raw 25552
tatataggaagtagtccttgaccaggcagcccagggcgctgtgcccccagaggtgctcctggagcagggcgccaggggaagaccgatgggcccttggtggaagctgaagagacggtgaccattgtcccctggccccaaatatcaaatgcatcgacgtccaggatcgcctggcgcagtaatagacgcctgtgtcgtcgggtctcaggttgctcatttgtaaatggccaacactgttggagtcatccttgagacggtgaatcttcccttcacagacgcggcgtactctttacttccaccatacgtttcattctgacgaaagtgatccactcagcccttcctggaggctgacggacccagccaagtgatatcactaagactgaatcctgagactacacaggagagtctcagagaccgccctggctgtgccaagccccccccgactccgccagtcgcccctcgcactggacacctctaaaaaaactacaaggaaaatcaagattagcccaaactcatggttggtggtctgtgctcagtgctgatcacaagtggaaactcctgggaatctcacggctggggctcctctctcttgcgacgacactaatcgagcaccggtcgtgtatatactgtctgatggcgcgagggaggcgatacg

SEQ ID NO: 791197 - DNA, 606 bp, Homo sapiens
  misc_feature: 25601.UNK.UNK.UNK.pb.heavy.1.raw 25601
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacacccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcgg

SEQ ID NO: 791198 - DNA, 614 bp, Homo sapiens
  misc_feature: 25649.UNK.UNK.UNK.pb.heavy.1.raw 25649
cccgacacggcttgctagggactttggagctaaggacgacatattgcctttagacagtcgaagggtgacgccttagctaccactgaacgtttagcgcgccagatgcggtctggatgaccctaactcgcagcttatcgatgatctactgcacgctcaaccaaccaggtcttgatgcgcgcgataggactgacgggatcgctacagacattttaactcgctagtaacttaattgagatcctagggatgggataggaaatagaatccaccctatcaccccccacatagcctgctgcgtgttgagtttacttttatttcgtgttggaatgagttgaacttccgggaagtggagtaatgggtttgtctacttccccctaaccgcaaagtactagttttacggagtggcgttgcaagccatagccagtcacaggtaataaacaattcaacgtggcgtaaagatggccgcttgctgtgggccattgcaagctgggtttgcagcattgtgcatgctagacgacaatatgaaatctggcgggacccctagtggcccaagatggccgctagcgggttccgccagcttttgacctggaccaggggtgcatagcctggcccagcct

SEQ ID NO: 791199 - DNA, 606 bp, Homo sapiens
  misc_feature: 25650.UNK.UNK.UNK.pb.heavy.1.raw 25650
gaaggctgggcaggctatgcaccctggtccaggtcaaaagctgcggaacccgctagcggccatctggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttagggaagtagacaaacccattactccacttcccggaagttcaactcattccaacacgaaataaaagtaaactcaacaccccaagcaggctatgtgggggggtgataggggtggattctatttcctatcccatcccctaggaatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcgg

SEQ ID NO: 791200 - DNA, 716 bp, Homo sapiens
  misc_feature: 25660.44.36.D03.1.pb.heavy.1.raw 25660
ctatgcgccttgccagcccgctcagacagtatataggaaggtagtcctttgaccaggcagcccagggccgctgtgctctcggaggtgctcctggagcagggcgccagggggaagaccgatgggcccttggtggaggctgaggagacggtgaccagggttccctggccccagtggcagttcctgatataaacacaacacaataaatacatgcccttgttgtcctcggttttttttcaggttagtcattcgcagaatcaatgagttcttgaaagtcatctctgagagggtgaatctggctttcacagacgcggcgtactctgtgataaagctggcaactttgttttactgcggccaagccactccagccccttccctggagcctggcgacccagtccatatagtggtcactgatggtgaatccagaggcgacacaggagagtctcaggccgaccctccaggctggaccaagtctcccccggactccaccaaacctgcacttcactctggacaccttgtaaaataacaacaaggaaaacccagctcaggcccgaactccatggtgcagtcctctgtgttcagtgctgatcaccaaatgaaaacacctggaattctgggctggggctccgctctcagagctccccaagagagatcgtgacgcagctaaatcgagcaccggtcgtgtatatactgtctgatggcgcgagggaggcgatacg

SEQ ID NO: 791201 - DNA, 610 bp, Homo sapiens
  misc_feature: 25682.UNK.UNK.UNK.pb.heavy.1.raw 25682
gagaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 791202 - DNA, 709 bp, Homo sapiens
  misc_feature: 25699.44.55.E11.1.pb.heavy.1.raw 25699
ctatgcggccttgccagcccgctcagacagtatataggaagtagtccttgaccaggcagcccaggccgctgtgcccccagaggtgctcttggaggagggtgccagggggaagaccgatgggccctggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtcctggagatggtgaatcggcccttccacggagtctgcgtagtatgtgaaatcaccagtataaaatgactgagacccactcagccccttccctggagcctggcggacccaactcatgtagttgctggctgacggtgagcccagaggctgcacaggagagtctcctgggaccccccaggctggactaagccctcctccagactccatcagccgcacctcacactggacaccttttaaaagtccaacaaggagaacccagctcagccaaaactccatggtgagtcctctgtgttcagtgctgatccaccgatggaaacacctcggaatcccagtgctgggctcctctccccccccaaacccaacgtgcgagtgctaaatcgagcaccggtcgtgtatatactgtctgatggcgcgagggaggcgatacg

SEQ ID NO: 791203 - DNA, 706 bp, Homo sapiens
  misc_feature: 25706.44.55.E11.1.pb.heavy.1.raw 25706
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttctggaattgtccctggagatggtgaatcggcccttcacggagtctgcgtagtatgtgaaatcaccagtataaatgactgagacccactccagccccttccctggagcctgggcggacccaactcatgtagttgctgctgacggtgagcccagaggctgcacaggagagtctctgggacccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacactcggaatcccagtgctgggctcctctcccccccaaacccaacgtgcgagtgctaaatcgagcaccggtcgtgtatatactgtctgatggcgcgagggaggcgatacg

SEQ ID NO: 791204 - DNA, 722 bp, Homo sapiens
  misc_feature: 25805.44.55.E11.1.pb.heavy.1.raw 25805
cgtatcgcctccctcgcgccatcagacagtatatacacgaccggtgctcgatttagcactcgcacgttgggtttgggggggagaggagcccagcactggggattccgaggtgtttccattcggtgatcagcaacctgaacacaagaggaactcactcatggagtttggctgagctggggttctccttgttggacttttaaaaaggtgtccagtgtgaggtgcggctgatggagtctggaggaggcttagtcccagccctggggggctcccagagactctcctgtgcagcctctgggctaccgtcagcagcaaactacatgagttgggtccgccaggctccagggaaggggcttggagtgggtctcagtcatttatactggtgatttcacatactacgcagactccgtgaagggccgattcaccatctccaggggacaattccaggaacacggtttatcttcaaatgaacaacctgagaggcgacgacacggccgtcattactgtgcgagacaagtcggcgcgctcggagtgggttattattcgtttgacttctggggccagggaaccctggtcaccgtcgcctccgcctccaccaagggcccatcggtcttccccctggcaccctcctccaagagcacctctggggcgcacagcgggccctgggctgcctggtcaaggactacttcctatatactgtctgagcgggctggcaaggcgcatag

SEQ ID NO: 791205 - DNA, 731 bp, Homo sapiens
  misc_feature: 25818.UNK.UNK.UNK.pb.heavy.1.raw 25818
cgtatcgcctccctcgcgccatcagagcagtatatacaccggaccggtgctccgatttagtactcactcagtcgcggggagctctgggagaggagccccagcactagaagtcggcggtgtttccattcggtgatcagcactgaacacagaggactcaccatggagtttgggctgagctgggtttccctcgttgctctttaagaggtgtccagtgtcaggtgcagcttggtggagtctgggggaggcgtggtccagcctgggaggtccctgagacctcctgttggcagcgtctggattcaccttcagtacctatggcatgcactgggtccgccaggctccaggcaaggggtggagtgggtggcacttatatggtatgatggaagtaataaatactatgcagactccgtgaagggccgattcaccatctcccagagacaattccaagaacacgctgtatctgcaaatgaacagcctgagagccgaggacacggctgtgtattacttgtgcgagggacatattgtagtactaccacctgctgggactacttaactacggtatggacgtctgggccaaggacccacggtcaccgtctcctcagcctccaccaagggccatcggtcttccccctggcacctcctccaagagcacctctggggcacagcggccctgggctgcctggtcaaggactacttcctatatactgtctgagcgggctggcaagggcgcatag

SEQ ID NO: 791206 - DNA, 724 bp, Homo sapiens
  misc_feature: 25830.UNK.UNK.UNK.pb.heavy.1.raw 25830
cgtatcgcctccctcgcgccatcagacagtatatacacgaccggtggctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcacttatatggtatgatggaagtaataaatactatgcagactccgtgaaggggccgattcaccatctccagagacaattccaagaacacgctgtatctgcaaatgaacagcctgagagccgaggacacggctgtgtattactgtgcgaggacatatttagtactaccacctgctgggactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 791207 - DNA, 700 bp, Homo sapiens
  misc_feature: 25844.44.55.E11.1.pb.heavy.1.raw 25844
ctatgcgccttgccagcccgctcagacagtatataggaagtagtccttgaccaggcagccagggccgctgtgcccccagaggtgctcttggaggaggtgccaggggaagaccgatgggcccttgtggaggcggaggcgacggtgaccagggttccctggccccagaagtcaaacgaataataaccactccgagcgccgacttgtctcgcacagtaatagacggccgtgtcgtcgcctctcaggttgttcatttgaagataaacgtgtcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaaactccatggtgagtcctctgtgttcagtgctgatcaccgaatggaaacacctcggaatcccagtgctgggctcctctcccccccaaaccaacgtgcgagtgctaaatcgagcaccggtcgtgtatatactgtctgatggcgcgagggaggcgatacg

SEQ ID NO: 791208 - DNA, 606 bp, Homo sapiens
  misc_feature: 25846.UNK.UNK.UNK.pb.heavy.1.raw 25846
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttactttatttcgtgttggaatgagttgaacttccgggaagtggagtaatgggtttgtctacttccctaaccgcaaagtactagttttacgagtggcgttgcaaagccatagccagtcacaggtaataaacattcaacgtggcgtaaaagattggccgcttgctgtgggcatgcaagctgggtttgcagcattgtgcatgctagacgacaatatgaatctgcgggacccctagtggccaagatggccgctagcggttccgcagcttttgacctggaccagggtgcatagcctgccccagccttc

SEQ ID NO: 791209 - DNA, 683 bp, Homo sapiens
  misc_feature: 25859.44.45.E01.1.pb.heavy.1.raw 25859
cgtatcgcctccctcgcgccatcagacagtatatacacgaccggtgctcgattagtgagtcagtaagggaaaggggctgggagaggagcccagcactagaagtcggcgggtgtttccatttcgggtgatcagcactgaacacagaggactcaccatggagtttgggctgagctgggttttcctcgttgctcttttaagaggtgtccagtgtcaggttcagctggtgagtctgggggaggcgtggtccagcctgggacgtccctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgattctccgtctccagagacaattccaaggaacaccgtgtatctacaaatgaaatttgagagccgaggactcggctctctattattgtacgagcccatcgttctactgggggccagggagccctggtcaccgtctcctcagcctccaccaagggcccatcggtcttcccctggcgccctgctccaggagcagcctccgagagcaccagcggccctggctgcctggtcaaggactacttcctatatactgtctgagcggctggcaaggcgcatag

SEQ ID NO: 791210 - DNA, 674 bp, Homo sapiens
  misc_feature: 25896.44.21.B10.1.pb.heavy.1.raw 25896
cgtatcgcctcctcgcgcatccagacagtatatacacgaccggtgctcgatttagtgtcgtcgcagagagaggagcccagccctgggactgaaacagagagaactcaccatggagttttgggctgagctggctttttcttgtggctgttttaaaaggtgtccagtgtgaagtgcagctgttggagtcggggggaggcttggtacagccgggggggtccctgacactctcctgtgcagcctctggattcgcctttaatacctatgccatgatctgggtccgtcaggccccagggaaggggctggagtgggtctcatccattactggtggtagtgccacaaatgtcgcagactccgtgaagggccgcttcatcgtcctccagggacaattccaagaatacggtgttctgcagatgaagagcctgcgagtggacgacacggccctttattaactgtgccagaggtcgcagaagttacaacaattacaagtattactaactacatggacgtcttggggcaaagggacccggtcaccgtctcctcagcctccaccaagggcccatcggtcttcccctggcacctcctccaagagcacctctggggcacagcggccctgggctgcctggtcaaggactactttcctatatactgtctgagcgggctggcaaggcgcatag

SEQ ID NO: 791211 - DNA, 697 bp, Homo sapiens
  misc_feature: 25905.44.56.F01.1.pb.heavy.1.raw 25905
ctatgcgcttgccagccgctcagacagtatataggaagtagtccttgaccaggcagcccaggccgctgtgcccccagaggtgctcctggagcagggcgccaggggggaagaccgatgggcccttggtggagctgaagagacggtgaccattgtcccctggccccaaatatcaaatgcatcgacgtccaggatcgcctgcgcagtaatagacgctgtgtcgtcggtctcaggttgctcattgtaaatggcaccactgttgagtcatccttgagacggtgaatcttcccttcacagacgcggcgtactctttacttccaccataacgtttcattctgacgaaagtgatccactcaagccccttcctggagcctgacggacccagaccaagtgataatcactaagactgaatcctgagactacacaggagagtctcagagaccgccctggctgtgccaaggcccccccccgactccgcagtcgcccctcgcactggacaccttctaaaaaactacaaggaaaatcaagattagcccaaactccatggtggtgtctgtgctcagtgctgatcaccagtggaaactcctggaatctcacggctgggctcctctcccagagctcccctttgtgtgttcagacgtctgctaaatcgagcaccggtcgtgtatatactgtctgatggcgcgagggaggcgatacg

SEQ ID NO: 791212 - DNA, 606 bp, Homo sapiens
  misc_feature: 25962.UNK.UNK.UNK.pb.heavy.1.raw 25962
ccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatggcgcgcgataggactgacggatcgctacagacatttaactcgctagtaacttaattgagatgcctagggatgggataggaaatagaatccaccctatcacccccccacatagcctgcttggggtgttgagtttacttttatttcgtgttggaatgagttgaacttccgggaagtggggagtaatgggtttgtctacttcccctaaccgcaaaagtactagttttacgagtggcgttgcaagccatagccagtcacaggtaataaacaattcaacgtggcgtaaagattggccgctgctgtgggcattgcaagctgggtttgcagcattgtgcatgctagacgacaatatgaatctgcggacccctagtggccaagatggccgctagcgggttccgcagcttttgacctggaccaggtgcatagcctgcccagccttc

SEQ ID NO: 791213 - DNA, 699 bp, Homo sapiens
  misc_feature: 25995.44.36.D03.1.pb.heavy.1.raw 25995
cgtatcgcctccctcgcgccatcagacagtatatacacgaccggtgctcgatttagctgcgtcacgatctctcttgggagctctcagagaggtgccttagccctggattccaaggcatttcacttggtgatcagcactgaacacagaggactcaccatgagttggggctgcgctgggttttccttgttgctattttagaaggtgtccactgtgaaggtgcggctggtggagtctggggaggcttggtacagcgggggggtccctgagactctcctgtgcagcctctggattcatcttcagtgactatgccatgaactgggtccgccaggctccagggaagggctggagtggtttttcatatgttaatatgctggagataccacctactacgcagactctgtgaagggccgattcacaattccagggacaatgcaaagaactcctgtatctgaaaatgaacagcctgagagacgaggacacgctgtctacttctgttcgagagatcgggccacttggtcagtggctggttttgactactgggggcggggaacctggtcaccgtctcctcagcctccaccaagggccatcggtcttcccctggcgccctgctccaggagcacctccgagagcacagcggcctgggctgcctggtcaaggactacttcctatatactgtctgaggcggctggcaaggcgcat

SEQ ID NO: 791214 - DNA, 708 bp, Homo sapiens
  misc_feature: 26005.44.36.D03.1.pb.heavy.1.raw 26005
cgtatcgcctccctcgcgccatcagacagtatatacacgaccggtgctcgatttagctgcgtcacgatctctcttgggagctctcagagaggtgccttagccctggattccaaggcatttccacttggtgattcagcactgaacacagaggactcaccatggagttggggctgcgctgggttttccttgttgctattttagaaggtgtccactgtgaggtgcggctggtggagtctgggggaggcttggtacagcgggggggtccctgagactctcctgtgcagcctctggattcatcttcagtgactatgccatgaactgggtccgccaggctccagggaaggggctggagtgggtttcatatgttaatattgctggagataccacctactacgcagactctgtgaagggccgattcaccaattccagggacaatgccaagaactcactgtatctggaaatgaacagcctgagagacgaggacacggctgtctacttctgttcgagagatcgggccacttggtcagtggctggttttgactactgggccgggaaccctggtcaccgtctcctcagcctccaccaagggcccatcggtcttcccctggcgccctgctccaggagcacctccgagagcacagcggccctgggctgcctggtcaagactacttcctatatactgtctgagcgggctggcaaggcgcatag

SEQ ID NO: 791215 - DNA, 730 bp, Homo sapiens
  misc_feature: 26068.44.86.H09.1.pb.heavy.1.raw 26068
ctatgcgccttgccagcccgctcagacagtatataggaagtagtccttgaccaggcaggcccagggccgctgtgcccccagaggtgctcttggggagggtgccagggggaagaccgatggcccttggtggaggctgaggagacggcgaccgtggtcccttggccccaggcgtccataccattggagtagagcatgtcatatctgtatccacgagcccccatctctcgcacagtagtagacagccgtgtcctcggctctcaggctattcatttccagatatagtgtgttcttcgaattgtctctggagatggtgaatcggccccttcacggaatctacataatatttatacttccatcataccatataagtgccacccacctcagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaagagcaacgaggaaaacccaggtcagcccaaactccatggtgagtcctctgtgttcgtggctgatcaccgactggaaacaccgccgacttctggtgctgggccctctccccagagctccccccaaaccaagtctatagcactaatcgagcaccggtcgtgtatatactgtctgatggcgcgaggggaggcgatacg

SEQ ID NO: 791216 - DNA, 695 bp, Homo sapiens
  misc_feature: 26088.44.55.E11.1.pb.heavy.1.raw 26088
cgtatcgcctccctcgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctcttgttggacttttaaaaggtgtccagtgtgaggtgcggctgatggagtctggaggaggcttagtccagcctgggggtccagagactctcctgtgcagcctctgggctcaccgtcagcagcaactacatgagttggtccgccaggctccagggaaggggctggagtgggtctcagtcatttatactgtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtgttattattcgtttgacttctggggccagggaaccctggtcaccgtcgctcgcctccacaagggcccatcggtcttcccctggcaccctcctccagagcacctctggggcacagcggccctgggctgcctggtcaaggactacttccctatatactgtctgagcgggctggcaaggcgcatag

SEQ ID NO: 791217 - DNA, 687 bp, Homo sapiens
  misc_feature: 26099.44.36.D03.1.pb.heavy.1.raw 26099
ctatgcgcctgccagcccgctcagacagtatataggaagtagtccttgaccaggcagcccagggccgctgtgctctcggaggtgctcctggagcaggcgccaggggaagaccgatgggcccttgtggaggctgggagacggtgaccagggtttcctggcccagtggacagttcctgattaaaacacaacaaataatacatgcccgtgtctcgttttcaggttagtcattcgcagaatcaatgagttcttgaagtcatctcttgagagggtgaatctggcttcacagacgcgcgtactctgtgataagctggcaacttgtttttactgcggccaagccactccgcccttcctggagcctggcggacccagtccatatagtggtcactgatggtgaatccagaggcgacacaggagagtctcaggaccctccaggctggaccaagtctccccggactccaccaactgcacttcactctggacaccttgtaaaataacaacaaggaaaaaacccagctcagcccgaactccatggtgagtcctctgtgttcagtgctgatcaccaaatgaaaaacacctggaattctggggctggggctccgctctcagagctcccaagagagatcgtgacgcagctaaatcgagcaccggtcgtgtatatactgtctgatggcgcgaggaggcgatacg

SEQ ID NO: 791218 - DNA, 693 bp, Homo sapiens
  misc_feature: 26137.44.27.C05.1.pb.heavy.1.raw 26137
ctatgcgccttgccagcccgctcagacagtatatagaagtagtccttgaccaggcagcccagggccgctgtgctctcggaggtgctcctggagcagggcgccaggggaagaccgatggccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcacggaatcaccgtagacttgatttcctccatgaaatgacacacctgccacccactccagcccctcgcctggagcctggcggaccactgcatattccaattatcgaaggtgaatccagaggctgcacaggagagtctcagggaccccctactgggccacgcctcccccagactccacgaattgcacctgacacatgacacctcttaagaggcaacgaggaaaacccagctcagcccaaactccatggtgagtcctctgtgttcagtgatgatcaccgagtggaaacaccggcgacttccagtgctgggctcgtctccagccccaaacccttcgatcgcgtctaaatcgagcaccggtcgtgtatatactgtctgatggcgcgaggaggcgatacg

SEQ ID NO: 791219 - DNA, 705 bp, Homo sapiens
  misc_feature: 26147.44.55.E11.1.pb.heavy.1.raw 26147
ccgtatcgcctccctcgcggccatcagacagtatatacacgaccggtgctcgatttagcactcgcacgttgggtttggggggagaggacgcccagcactgggattccgaggtgttcccattcggtgatcagcactgaacacagaggactccaccatggagttttggctgagctgggttctccttgttggacttttaaaaggtgtccagtgtgagggcggctgatggagtctggaggaggcttagtccagcctggggggtcccagagactctcctgtgcaggctgggctcaccgtcagcagcaactacatgagttgggtccgccagctccagggaaggggctggagtgggtctcagtcatttatactgggatttcacatactacgcagactccgtgaagggccgattcaccatctccagggacattccaggaacacggtttatcttcaatgaacaacctgagaggcgacgacacggccgtctattactgtgcgagacaagtcggcgctcggagtggttattattcgtttgacttctggggccagggaaccctggtcaccgtcgcctccgctccacccaagggccatcgcgtcttccccctggcaaccctcctcaagagcacctctggaggccacacgcggccctgggctgcctggtcaaggactacttcctatatactgtctgagcggcgctggcaaggcgcatag

SEQ ID NO: 791220 - DNA, 685 bp, Homo sapiens
  misc_feature: 26160.UNK.UNK.UNK.pb.heavy.1.raw 26160
ctatgcgccttgccagcccgctcagacagtatataggaagtagtccttgaccaggcagccagggccgctgtgcccccagaggtgctcctggagcagggcgccaggggaagaccgatgggcccttggtggaagctgaggtgacaatgaccaggtccctgcccccagatctcaaaggctccatgcgagctggggtacggacctctcgcacagtagtagacggccgtgttcgtcggatttcaaagaactcattgtcatggagactgtgtctgtggacttgtccgcggtaatcgtaattctgccccggaagtctcgtgcgtaggtgagtgagccaaaaagagggatgattccacccatccactcaagcccttgtccaggggcctggcgcacccagttgatggtataagtagtggaactggtagtacttccagaggccgtgcaggaaagggtcaccgaggaccaaggttgcggcattctagtccccagactgcaccagttgcaccagggaactggacacctgttgctgctgccaccacaaagaggaacctccagggtcccagtccatggtgatgagctgtgctcccagggcttctttttagaggaggaatttgtgggttgtcagtagattctaaatcgagcaccggttcgtgtatatactgtctgatggcgcgagggaggcgataaacga

SEQ ID NO: 791221 - DNA, 691 bp, Homo sapiens
  misc_feature: 26161.44.55.E11.1.pb.heavy.1.raw 26161
ctatgcgccttgccagcccgctcagacagtatataggaagtagtccttgaccaggcagccaggccgctgtgccccagaggtgctctggaggagggtgccagggggagaccgatgggcccttggtggaggcggaggcgacgggtgaccagggttccctggccccagaagtcaaacgaataataaccactccgagcgccgacttgtctcgcacagtaatagacggccgtgtcgtcgcctctcaggttgttcatttgaagataaaccgtgttcctggattgtccctggagatggtgaatcggcccttcacggagtctgcgtagtatgtgaaatcaccagtataaatgactgagacccactccagcccttccctggagcctggcggacccaactcatgtagttgctgctgacggtgagcccagaggctgcacaggagagtctctggaccccccaggctggactaagcctcctccagactccatcagccgcacctcacactgacaccttttaaaagtccaacaaggagaacccagctcagccaaaactcatggtgagtcctctgtgttcagtgctgatcaccgaatggaaacacctcggaatcccagtgctgggctcctctccccccaaaccaacgtgcgagtgctaatcgagcaccggtcgtgtaatactgtctgatggcgcgaggaggcgatcg

SEQ ID NO: 791222 - DNA, 609 bp, Homo sapiens
  misc_feature: 26211.UNK.UNK.UNK.pb.heavy.1.raw 26211
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtacttttgcggttaggggaagtagacaaacccattactccacttcccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 791223 - DNA, 712 bp, Homo sapiens
  misc_feature: 26257.UNK.UNK.UNK.pb.heavy.1.raw 26257
cgtatcgcctccctcgcggccatcagacagtatatacacggaccggtgctcgatttagcagacgtctgaacacacaaaggggagctctggagaggagccccagccgtgagattcccaggagtttccacttggtgatcagcactgagcacagacaccaccatggagtttgggctaatcttgattttccttgtagttttttagaaggtgtccagtgcgaggggcgactggcggagtcggggggggcttggcacagccagggcgggtctctgagactctcctgtgtagtctcaggattcagtcttagtgattatcacttgcctggtccgtcaggctccagggaagggggcttgagtggatcactttcgtcagaatgaaacgttatggtggaagtaaagagtacgccgcgtctgtgaagggaagattcaccgtctcaagggatgactccaacagtgttggccatttacaaaatgagcaacctgagacccgacgacacaggcgtctattactgcgccaggcgatcctggacgtcgatgcatttgatatttggggccaggggacaatggtcaccgtctcttcagcttccaccaagggcccatcggtcttcccctggcgccctgctccaggagcacctctgggggcacagcggccctgggctgcctggtcaaggactacttcctatatactgtctgagcgggcctggcaaggcgcatag

SEQ ID NO: 791224 - DNA, 648 bp, Homo sapiens
  misc_feature: 26272.44.86.H09.1.pb.heavy.1.raw 26272
cgtatcgcctcccccgcgccatcagacagtatatacacgaccggtgctcgatttagtgctatagacttggtttggggatgctttctgagagtcaaggacctcctgtgcaagaacatgaagcactgtggtttttcctcctgctggtggcagctcccagatgggtcctgtcccaggtgcagctgcaggagtcgggcccaggactggtgaggccttcggaaccctgtctctcatctgcactgtctctggagtttccatcagttctgatcattcttggggctggatccggcagccccagggaggggaatggagtggattggtgacatccattatactgggcgacgtacactctccgtccctcaagagtcgtctcaccatttcgagggacacgtccatgaccgcttctccctgaaactgacctccgtgaccgcccgcggacacggccgtttatttctgtgcgaggcgagactggtctttcaatctatggggccgtggcaccctggtcactgtctcctcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 791225 - DNA, 653 bp, Homo sapiens
  misc_feature: 26282.44.57.F02.1.pb.heavy.1.raw 26282
cgtatcgcctccctcgcgccatcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 791226 - DNA, 713 bp, Homo sapiens
  misc_feature: 26313.44.27.C05.1.pb.heavy.1.raw 26313
cgtatcgcctccctcgcgccatcagaccagtatatacacgaccggtgctcgatttagacgcgatcgaagggtttgggggagccctgggagacgagcccagcactggaagtcgccggtgtttccactcggtgatcatcactgaacacagaggacttcacccatggagtttgggcctgagctgggttttcctcgttgcccctttaagaggtgtcatgtgtcaggtgcaattcgtggagtctggggagcgtggcccagtagggggtccctgagactctcctgtgcagcctctggattcaccttcgataattggaatatgcagtgggtccgccaaggctccaggcgagggctggagtgggtggcaggtgtgtcatttcatggaggaaatcaagtcctacggtgaaattccgttgagggccgattcaccatctccagagacaattccgagaacacagtgtctcttcaaatgaacagcctgagacctcaggacacgccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcgcctggtcaaggactacttcctatatactgtctgagcgggctggcaaggcgcatag

SEQ ID NO: 791227 - DNA, 691 bp, Homo sapiens
  misc_feature: 26330.UNK.UNK.UNK.pb.heavy.1.raw 26330
cgtatcgcctccctcgcgccatcagacagtatatacacgaccggtgcctcgatttagacgcgcgatcgaagggttggggctgggagacgagcccagcactgaagtcgccggtgtttccactcggtgatcatcacctgaacacagaggactcaccatggagtttgggctgagctgggttttctcgttgccccttaagaggtgtcatgtgtcaggtgcaattcgtgagtctggggggagcgtggccagtaggggtccctgagactctcctgtgcagccctggattcaccttcgataattggaatatgcagtggtccgccaggctccaggcgagggctggagtgggtggcaggtgttcatttcatggaggaaatcaagtctacggtgattccgtgagggccgattcaccatctccagagacaattccgaagaacacagtgtctcttcaaatgaacagcctgagacctcaggacacggccgtgtatttttgtgcgagactatctgtttccaaaatcggttcattcgacgcctggggccagggaaccctggtcaccgtctcctcgcctccaccaagggcccatcggtcttccccctggcgccctgctccaggagcacctccgagagcacagcggcctgggctgcctggtcaagactacttccatatactgtctgagcgggctggcaaggcgcatag

SEQ ID NO: 791228 - DNA, 546 bp, Homo sapiens
  misc_feature: 26340.44.38.D05.1.pb.heavy.1.raw 26340
ctatgcgccttgccagcccgctcagacagtatataggaagtagtccttgaccaggcagcccagggccgctgtgccccccagaggtgctcctggagcagggcgccagggggaagaccgatggcccttggtggaagctgaggagacggtgaccgtggtcccttggccccagacgtccataccgtagtagtagtatgcaactccccgaactcccgcaaccggctcttgcacagtaatacacagccgtgtcctcgctctcagactgttcatttgcagatacagcgtgttcttgggcgttgtctctggagatggtgaatcggcccttcacggagtccgcgtagcttgtgctactcccatcactataatacgtgagacccacaccagcccccttccctggagcttggcggacccagtgcatccagtagctactgaaggtgaatccagaggctgcacaggagagtctcagggaccccccaaacccaactatcagatactaaatcgagcaccggtcgtgtatatactgtctgatggcgcgagggaggcgatacg

SEQ ID NO: 791229 - DNA, 698 bp, Homo sapiens
  misc_feature: 26349.UNK.UNK.UNK.pb.heavy.1.raw 26349
gccgccttgccagccgctcagacagtatataggaagtagtccttgaccaggcagcccaggccgctgtgctctcggaggtgctcctggagcagggcgccagggggaagaccgatgggcccttggtggagggctgaggagacggtgaccagggttccctggccccagtgacagttcctgatataaacacaacacaataatacatgcccgtgtcctccggttttcaggttagtcattcgcagaatcaatgagttcttgaagtcatctcttgagagggggtgaatctggctttcacagacgcggcgtactctgtgataaagctggcaactttgtttttactgcggccaagccactccagccccttccctggagcctggcggacccagtcatatagtggtcacttgatggtgaatccagaggcgacacaggagagtctcagggaccctccaggctgggaccaagtctcccccggactccaccaactgcacttcactctggacaccttgtaaaataacaacaaggaaaacccagctcagcccgaactccatggtgagtcctctgtgttcagtgctgatcaccaaatgaaaacacctggaattctgggctggggctccgctctcccccaagagagatcgtgacgcagctaaatcgagcaccgggtcgtgtatatactgtctggatggcgcgagggaggcgatacg

SEQ ID NO: 791230 - DNA, 700 bp, Homo sapiens
  misc_feature: 26391.44.55.E11.1.pb.heavy.1.raw 26391
ctatgcgccttgccagccgctcagacagtatataggaagtagtccttgaccaggcagcccagggccgctgtgccccagaggtgctcttggaggagggtgccagggggaagaccgatgggcccttgtggaggcggaggcgacggtgaccagggttccctggcccagaagtcaaacgaataataaccactccgagcgccgacttgtctcgcacagtaatagacgggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctggacccccaggctggactaagcctcctccagactccatcagccgcacctcacactggacaccttttaaaagtccaacaagagaacccagctcagccaaaactccatggtgagtcctctgtgttcagtgctgatcaccgaatggaaacacctcggaatccagtgctgggctcctctcccccccaaacccaacgtgcgagtgctaaatcgagcaccggtcgtgtatatactgtctgatggcgcgagggagggcgatacg

SEQ ID NO: 791231 - DNA, 678 bp, Homo sapiens
  misc_feature: 26399.UNK.UNK.UNK.pb.heavy.1.raw 26399
ctatgcgccttggccagccccgctcagacagtatataggaagtagtccttgaccaggcagcccagggccgctgtgcccccagaggtgctcttggaggagggtgccaggggggaagaccgatgggcccttggtggaggctgaggagacggtgaccagggttccctggccccagtggtcaaagtagttggtgacgaactgccctactctcgcacagtaatacacggccgtgttccgcggcggtcacagagcctcagcttcagggagaactggttcttggacgtgtctactgatatggtgactcgactcttgagggacgggttgtagtaggtgctcccactataatagatactcccaatccactccagcccccttccctggggggctggcggatccagccccagtagtaactactactgctgatggagccaccagaggaccagtgcaggtgagggacagggtctccgaggcttcaccagtccctgggccccgaactcctgcagctgcagctgggacaggacccatctgggagccgccaccagcaggaggaagaaaccaaggtgcttcatgttcttgcacaggaggtccatgactctcagaaaagcccccgcggaatctacactactaaatcgagccaccggtcgtgtatatactgtctgatggcgcgagggaggcgatacg

SEQ ID NO: 791232 - DNA, 709 bp, Homo sapiens
  misc_feature: 26459.UNK.UNK.UNK.pb.heavy.1.raw 26459
ctatgcgccttgccagcccgctcagacagtatataggaagtagtccttgaccaggcagcccaggccgctggtgctctcggaggtgctcctggagcagggcgccagggggaagaccgatgggccttggtggaggctgaggagacggtgaccagggttccctggccccagtggacagttcctgatataaacacaacacaataatacatgcccgtgtcctcggttttcaggttagtccattcgcagaatcaatgagttcttgaagtcatctcttgagagggtgaatctggctttcacagacgcgggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctcccccaagagagatcgtgacgcagctaaatccgagcaccggtcgtgtatatactgtctgatggcgcgagggaaggcgatacg

SEQ ID NO: 791233 - DNA, 602 bp, Homo sapiens
  misc_feature: 26460.UNK.UNK.UNK.pb.heavy.1.raw 26460
ctatgcgccttgccagcccgctcagacagtatataggaagtagtccttgaccaggcagccagggccgctgtgctctcggaggtgctcctggagcagggcgccaggggaagaccgatgggcccttggtggaggccgaggagacggtgaccagggttccctggccccaggcgtcgaatgaaccgattttggaaacagatagtctcgcacaaaaaatacacgccgtgtcctgaggtctcaggctgttcatttgaagagacactgtgttctcggaattgtctctggagatggtgaatcgccctcacggaatcaccgtagacttgatttcctccatgaaatgacacacctgccacccactccagccctcgcctggagcctggcggacccactgcatattccaattatcgaggtgaatccagaggctgcacaggagagtctcagggaccccctactggggccacgctccccaactccacgaattgcacctgacacatgacacccttaagagggcaacgagaaacccagctcagcccaaacccttcgatcgcgtctaaatcgagcaccgtcgtgtatatactgttcgatggcgcgagggaggcgatacg

SEQ ID NO: 791234 - DNA, 720 bp, Homo sapiens
  misc_feature: 26470.44.85.H08.1.pb.heavy.1.raw 26470
ctatgcgccttgccagcccgctcagacagtatataggaaagtagtccttgaccaggcagcccagggccgctgtgccccagaggtgctcttggaggagggtgccaggggaagaccgatggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctcccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggctcctctcccagagctccccgcgactgagtgatactaaatcgagcaccggtcgtgtatatactgtctgatgcgcgagggaggcgatacg

SEQ ID NO: 791235 - DNA, 681 bp, Homo sapiens
  misc_feature: 26521.44.45.E01.1.pb.heavy.1.raw 26521
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagcccttgcctggagcctggcggacccagtgcatggcagagtcactgaaactgagtccggacgcaacacaggagagtctcagggacgtcccaggctggaccacgcctcccccagactccaccagctgaacctgacactggacacctcttaaaagagcaacgaggaaaaccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 791236 - DNA, 610 bp, Homo sapiens
  misc_feature: 26529.UNK.UNK.UNK.pb.heavy.1.raw 26529
cgtatcgcctccctcgcgccatcagacagtatatacacgacggtgctcgattagtacacgtgattagggattggggcagggtgaacacctgtggtttttcctcctgctggtggcagctccagatggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcagagtcgtctcacatttcgagggacacgtccatgaaccgcttctccctgaaactgacctccgtgacgccgcggacacggccgtttatttctgtgcgaggcgagactggtctttcaatctatggggccgtggcaccctggtcactgtctcctcagcttccaccaagggcccatcggtcttcccctggcgccctgctcaggagcactctgggggcacagcggcctgggctgcctggtcaaggactacttcctatatactgtctgagcgggctggcaaggcgcatag

SEQ ID NO: 791237 - DNA, 697 bp, Homo sapiens
  misc_feature: 26580.UNK.UNK.UNK.pb.heavy.1.raw 26580
ctatgcgccttgccagcccgctcagacagtatataggaagtagtccttgaccaggcagcccagggccgctgtgctctcggaggtgctcctggagcagggcgccagggggaagaccgatgggcccttggtggagctgaggagacggtgaccagggttccctggcccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcccccaagagagatcgtgacgcagctaaatcgagcaccgggtcgtgtatatactgtctgatggcgcgagggaggcgatacg

SEQ ID NO: 791238 - DNA, 707 bp, Homo sapiens
  misc_feature: 26594.UNK.UNK.UNK.pb.heavy.1.raw 26594
cgtatcgcctccccgcgcgccatcaggacagtatatacacaccggtgctcgatttagaagtcgcataaaggaaaggggagctcttgagagaggagcccagccctgggattttcaggtgtcttcattggtgaccaggacccgaaacagagagaagtctccatggagtttggggctgagctgcctttttcttgtggcttttttaaagggtgtcgtgtgtgaagtgcagtgtggagtctggggggtgcctgattcggcctgggaggtccctgaccctctcctgtgcggcctctggatttcacctttagtgccctataggcatgacctgggtccgcccgggctccagggaggggactggagtgggtctcagtatcggagctggtgtgtccactttacggaactccgtgaaggccgcttcaccatttccagggacacgattcgcagccgacaaattgtttctccaaatgaaaacctgagcccgaggacacaggcgtcaattactgtggaagccaggaccaccggtgacccccctgacaccttaccgtactggccgggggcacagtggtgaccgtcctctcagcctccaccaagggcccatcgtcttcccctggcgccctgccccagggagcacctccgaggcacagcggccctgggctgcctggtcaaggactacttcctatatactgtctgagcggctggcaaggcgctag

SEQ ID NO: 791239 - DNA, 648 bp, Homo sapiens
  misc_feature: 26614.44.86.H09.1.pb.heavy.1.raw 26614
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcggccaggactggtgaggccttcgggaaccctgtctctcatctgcactgtctctggagtttccatcagttctgatcattcttgggctggatccggcagcccccagggaggggaatggagtggattggtgacatccattatactggggcgacgtactactctccgtcctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggccatcggtcttccccctggcgccctgctcagggcacctctgggggcacagcggccctgggctgcctggtcaaggactacttcctatatactgtctgagcgggctggcaaggcgcatag

SEQ ID NO: 791240 - DNA, 687 bp, Homo sapiens
  misc_feature: 26629.44.36.D03.1.pb.heavy.1.raw 26629
ctatgcgcctgccagcccgctcagacagtatataggaagtagtccttgaccaggcagcccaggccgctgtgctctcggaggtgctcctggagcagggcgccaggggaagaccgatgggcccttggtggaggctgaggagacggtgaccagggttccctggcccagtggacagttcctgatataaacacaacacaataatacatgcccgtgtcctcggtttcagttagtcattcgcagaatcaatgagttcttgaagtcatctctgagaggtgaatctggctttcacagacgcggcgtactctgataaagctggcaactttgttttactgcggccaagccactccagccccttccctggagcctggcgaccagtccatatagtggtcactgatggtgatccagaggcgacacaggagagtctcagggaccctccaggctggaccaagtctcccccggactccaccaactgcacttcactctggacacttgtaaaataacacaaggaaaacccagctcagccgaactccatggtgagtcctctgtgttcagtgctgatcaccaaatgaaaacacctgggaattctgggctggggctccgctctcagagctccccaagagagatcgtgacgcagctaaatcgagcaccggtcgtgtatatactgtctgatggcgcgagggaggcgatacg

SEQ ID NO: 791241 - DNA, 718 bp, Homo sapiens
  misc_feature: 26765.UNK.UNK.UNK.pb.heavy.1.raw 26765
cgtatcgcctccctcgcgccatcagacagtatatacacgaccgtgctcgatttagtatcactcagtcgcggggagctcctgggagaggagcccagcactagaagtcggcggtgtttccattcggtgatcagcactgaacacagaggactcaccatggagtttgggctgagctgggttttctcgttgctctttttaagagttgtccagttgtcaggtgcagctggggagtctgggggaggcgtggtccagcctgggaggtcctgagactctcctgtgcagcgtctggattcaccttcagtacctatggcatgcactggtccgccagggctccaggcaaggggctggagtgggtggcacttatatggtatgatggaagtaataaatactatgcagactccgtgaagggccgattcaccatctccagagacaattccaagaacacgctgtatctgcaaatgaacagcctgagagccgagacacggctgtggtattactgtgcgaggacatattgtagtactaccacctgctgggactactactacggtatgggacgtctggggccaagggacacggtcaccgtctcctcagcctccaccaagggccatcggtctttcccctggcaccctcctccaagagcacctctgggggcacagcgccctgggctgcctggtcaaggactacttcctattactgtctgagcgggctggcaggcgcatag

SEQ ID NO: 791242 - DNA, 662 bp, Homo sapiens
  misc_feature: 26783.44.38.D05.1.pb.heavy.1.raw 26783
ctatgcgccttgccagccgctcagacagtatataggaagtagtccttgaccaggcagcccagggcgctgtgcccccagaggtgctcctggagcagggcgccaggggaagacgatgggcccttggtggaagctgaggagacggtgaccgtggtccttggccccagacgtccataccgtagtagtagtatgcaactcccgaactcccgcaccggctcttgcacagtaatacacagcgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagcttactgaaggtgaatccagaggctgcacaggagagtctcagggacccccaggctgaactagcctcccccatgcccacggtgccagagcccaaatcttgtgacacacctcccccgtgcccaaggtgcccagcacctgaactcctgggaggaccgtcagtcttcctcttccccccaaacccaactatcagatactaaatcgagcaccggtcgtgtatatactgtctgatggcgcgagggaggcgatacg

SEQ ID NO: 791243 - DNA, 689 bp, Homo sapiens
  misc_feature: 26824.UNK.UNK.UNK.pb.heavy.1.raw 26824
cgtatcgcctccctcgcgccatcagacagtatatacacgaccgggtgctcgatttagtgagtcagtaagggaaagggggctggggagagagcccagcactagaagtcgggcggtgtttccattcggtgatcagcactgaacacagaggactcaccatggagttttgggctgagctgggttttcctcgttgctcttttaagaggtgtccagtgtcaggttcagctggtggagtctgggggaggcgtggtccagccctgggacgtccctgagactctcctggtgttgcgtccggactcagtttcagtggactctgccatgcactgggtccgccaggctccaggcaagggctggagtgggtgggcagtcatctggtctgatggaagtaaaagatactatgggaaactccgtgaagggccgattctccgtctccagaggacaattccaagaacaccgtgtatctacaacatgaacaatttgagagccgaggaactcggctctctattattgtacgagcccatcgttctactggggccaggagccctggtcaccgtctcctcagcctccacaagggcccatcggtcttccctggcgccctgctccaggagcaccctccgagagcacagcggcctgggctgcctggtcaagggactacttcctatatactgtctgagcggctggcaggcgcatag

SEQ ID NO: 791244 - DNA, 704 bp, Homo sapiens
  misc_feature: 26839.44.55.E11.1.pb.heavy.1.raw 26839
ctatgcgccttgccagcccgctcagacagtatataggaagtagtccttgaccaggcagcccaggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgaggaggcgatacg

SEQ ID NO: 791245 - DNA, 707 bp, Homo sapiens
  misc_feature: 26848.44.55.E11.1.pb.heavy.1.raw 26848
cgtatcgcctccctcgcgccatcagacagtatatacacgaccggtgctcgatttagcactcgcacgttgggtttgggggggagaggagccccagcactgggattccgaggtgtttccattcggtgatcagcactgaacacagaggactcaccatggagtttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccaggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 791246 - DNA, 690 bp, Homo sapiens
  misc_feature: 26880.UNK.UNK.UNK.pb.heavy.1.raw 26880
cgtatcgcctccctcgcgccatcagacagtatatacacgaccggtgctcgatttaagtgagtcagtaagggaaaggggctgggagaggagcccagcactagaagtcggcggtgttttccattcggtgaatcagcactgaacacagaggactcaccatggagttttgggctgagctgggttttcctcgttgctcttttaagaggtgtccagtgtcaggttcagctggtggagtctgggggaggcgtggtccagcctggacgtcctgagactctcctgtgttgcgtccggactcagtttcagtgactctgccatgcactgggtccgccaggctccaggcaaggggctggagtgggtggcagtcatctggtctgatggaagtaaagaatactatggaaaactccgtgaagggccgattctccgtctccagagacaattccaagaaacaccgtgtatctacaaatgaacaatttgagagccgaggactcggctctctattattgtacgagcccatcgtttcttactggggccagggagccctggtcaccgtctcctcagcctccaccaagggcccatcggttcttccccctggcgcccttgctccaggagcacctccgagagcacagcggccctgggctgcctggtcaaggactacttcctatatactgtctgacgggctggcaaggcgcatag

SEQ ID NO: 791247 - DNA, 646 bp, Homo sapiens
  misc_feature: 26888.UNK.UNK.UNK.pb.heavy.1.raw 26888
ctatgcgcctgccagccccgctcagacagtatataggaagtagtcctgaccaggcagccagggccgctgtgcccccagaggtgccctggagcaggcgccaggggagaccgatggccctggtggaaagctgaggagacagtgagcaggcggtgccacggccccatagattgaaagaccagtctccgcctcgcacagaaataacggccgtgtccgcggcggtcacggaggtcagtttcaggagaagcggttcatggacgtgtcctcgaaatggtgagacgacctgagggacggagagtagtacgtcgcccagtataatggatgtcaccaatccactccattcccctccctgggggctgcggatccagccccaagaatgatcagaaactgatggaaactccagagacagtgcaggatgagagacagggttcccgaaggcctcaccagtctgggcccgactcctgcagctgcacctgggacaggacccatctggggagctgccaccagcaggggaaaaaccacaggtgcttgcatgtccttgcacaggaggtcttgactctcagaaaagcatccccaaacccaagttatagcactaaatcgagcaccgggtcgtgtatatactgtctgatggcgcgagggaggcgatacg

SEQ ID NO: 791248 - DNA, 690 bp, Homo sapiens
  misc_feature: 26889.44.27.C05.1.pb.heavy.1.raw 26889
ctatgcgccttgccagcccgctcagacagtatataggaagtagtccttgaccaggcagcccaggccgctgtgctctcggaggtgctcctggagcagggcgccaggggaagaccgatgggcccttggtggaggccgaggagacggtgaccagggttcctggcccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggatcaccgtagacttgatttcctccatgaaatgacacacctgccacccactccagccctcgcctggagctggcggacccactgcatattccattatcgaaggtgaatccagaggctgcacagagagtctcagggaccccctactggggcacgcctccccagactccacgaattgcacctgacacatgacacctcttaagaggcaacgaggaaacccagctcagcccaaactccatggtgagtcctctgtgttcagtgatgatcaccgagtggaaacaccggcgacttcagtgctgggccgtctccagggctccccaaacccttcgatcgcgtctaatcgagcaccggtcgtgtatatactgtctgatggcgcgagggaggcgatacg

SEQ ID NO: 791249 - DNA, 659 bp, Homo sapiens
  misc_feature: 26893.44.86.H09.1.pb.heavy.1.raw 26893
ctatggcccttgccagcccccgctcagacagtatataggagtagtccttgaccaggcagccagggccgctgtgccccagaggtgctcctggagcaggggcgcaggggaagaccgatggcccttggtggaagctgagggagacgtgaccaggggtgccacggccccatagattgaaagaccagtctcgcctcgcacagaaataaacggccgtgtccgcggcgggtcacggagggtcagtttcagggagaagcggttcatggacgtgtccctcgaaatggttgagacgactcttgagggacggagagtagtacgtcgccccagtataatggatgtcaccaatccactccattcccctccctgggggctgccggatccagccccaagaatgatcagaactgatgggaaaactccagagacagtgcagatgagagacagggttccggaaggcctcaccagtcctgggcccggactcctgcagctgcacctgggacaggacccatctgggagctgcccaccagcaggaggaaaaaccacagggtgcttcatgttcttgcacaggaggtccttgactctcagaaagcatcccaaacccaagtctatagcactaaatcgagcaccggtcgtgtatatactgtctgatggcgcgaggaggcgatacg

SEQ ID NO: 791250 - DNA, 689 bp, Homo sapiens
  misc_feature: 26896.44.36.D03.1.pb.heavy.1.raw 26896
cgtatcgcctccctcgcgccatcagacagtatatacacgaccggtgctcgattagctgcgtcacgatctctcttgggggagagcggagccccagccccagaattccaggtgttttcattggtgatcagcactgaacacagaggactcaccatggagttcggctgagctggttttccttgttgttattttacaggtgtccagagtgaagtgcagttggtggagtccgggggagacttggtccagcctggagggtcctgagactctcctgtgtcgcctctggattcaccatcagtgaccactatatggactgggtccgccaggctccagggaagggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacggcatgtattattgtgttgtgtttatatcaggaactgtccactgggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791251 - DNA, 615 bp, Homo sapiens
  misc_feature: 26909.44.23.C01.1.pb.heavy.1.raw 26909
cgtatcgcctccctcgcgccatcagacagtatatacacgaccggtgctcgatttagtacacgtgattagggattggggcagggtgaacacctgtggtttttcctcctgctggtggcagctcccagatgggtcctgtcccaggtgcagctgcaggagtcggcccaggactggtgaggccttcgggaaccctgtctctcatctgcactgtctctggagtttccatcagttctgatcattcttggggctggatccggcagcccccagggagggaatggagtggattggtgacatccattatactggggcgacgtactactctccgtccctcagagtcgtctcaccatttcgagggacacgtccatgaacgcttctccctgaaactgacctccgtgaccgccgcggacacgccgtttatttctgtgtgaggcgagactggtctttcaatctatgggggcccgtggcaccctggtcactgtctcctcagcttccaccaaggcccatcggtcttccccctggcgccctgctccaggagcacctctggggcacagcggccctgggctgcctggtcaaagacacttcctatatactgtctgagcgggctggcaaggcgcatag

SEQ ID NO: 791252 - DNA, 601 bp, Homo sapiens
  misc_feature: 26927.UNK.UNK.UNK.pb.heavy.1.raw 26927
gccgctcagacagtatataggaagtagtccttgacagcagccagggccctgtgcccagaggtctcttgaggaggtgcaggggaagacgatggcccttggtggaggctgaggagacggtgaccagggttccctggccccagtgtcaaagtagttggtgacgaactgccctactctcgcacagtaatacacggcgtgtccgcgcggtcacagagctcagcttcaggagaactggtcttggacgtgtctactgatatggtgactcgactcttgagggacggttgtagtaggtgctcccactataatagatactccaatcactcagccttccctgggctggcggatccagccagtataactatactgctgatggagccaccagagacagtgcagtgagggacaggtctccgaaggcttcaccagtctggccgactcctgcagctgcagctggacaggaccatctggagcgcacagcaggaggaagaaccacagtgcttcatgttcttgcacaggagtccatgactctcagaaagcccgcggaatctacactataaatcgagcaccgtcgtttatatactgtctgatgcgcgagggaggcgatacg

SEQ ID NO: 791253 - DNA, 706 bp, Homo sapiens
  misc_feature: 26928.44.55.E11.1.pb.heavy.1.raw 26928
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggttgaccagggttccctggcccagaagtcaaacgaataataaccactccgagcgccgacttgtctcgcacagtaatagacggccgtgtcgtcgcctctcaggttgttcatttgaagataaaccgtgtttcctggaattgtccctggagatggtgaatcggcccttcacggagtcctggcgtagtatgtgaaatcaccagtataaatgactgagacccactccagccccttccctggagcctggcggacccaactcatgtagttgctgctgacggtgagcccagaggctgcacaggagagtctctggaccccccaggctggactaagccctctccagactccaatcagccgcacctcacactggacaccttttaaaagtccaacaaggagaacccagctcagccaaaactccatggtgaggtcctctgtgttcagtgctgatcaccgaatggaaacacctcggaatcccagtgctgggctcctctccccaaaccaacgtgcgagtgctaaatcgagcaccggtcgtgtatatactgtctgatggcgcgagggaggcgatacg

SEQ ID NO: 791254 - DNA, 685 bp, Homo sapiens
  misc_feature: 26957.44.36.D03.1.pb.heavy.1.raw 26957
cgatcgcctccctcgcgccatcagacagtatatacacgaccggtgctcgatttagctgcgtcacgatctctcttgggggagagcggagccccagcccagaattcccaggtgttttcatttggtgatcagcactgacacagaggactcaccatggagtcgggctgagctgggtttcctgttgttattttacaagggtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaccgaggacacgggcatgtattattgtgttgtgtttatatcaggaactgtccactggggccagggaaccctggtcaccgtctcctcagcctccaccaaggggcccatcggtcttccccctggcgcctgctccaggagcacctccgagagcacagcggccctgggctgcctggtcaaggactacttcctattactgtctgagcgggctggcaaggcg

SEQ ID NO: 791255 - DNA, 696 bp, Homo sapiens
  misc_feature: 26959.44.36.D03.1.pb.heavy.1.raw 26959
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggacaagccactccagccccttccctggagcctggcggacccagtccatatagtggtcactgatggtgaatccagaggcgacacaggagagtctcagggaccctccaggctggaccaagtctcccccggactccaccaactgcacttcactctggacacctgtaaaataacaacaaggaaaacccagctcagcccgaactccatggtgagtcctctgtgttcagtgctgatcaccaaatgaaaacacctgggaattctggggctggggctccgctctccccaagagagatcgtgacgcagctaaatcgagcaccggtcgtgtatatactgtctgatggcgcgagggaggcgatacg

SEQ ID NO: 791256 - DNA, 637 bp, Homo sapiens
  misc_feature: 26967.44.53.E09.1.pb.heavy.1.raw 26967
cgtatcgcctccctcgcgccatcagacagtatatacacgaccggtgctcgatttagagagagtgtgttgggtttggggaagcacctgtggttcttcctcctgctggtggcggctcccagatgggtcctgtctcagccgcagctgcgggagtcgggcccaggactggtgaagccttcggagaccctgtccctcacgtgcacgtctctggtgcctccatcgacagaagtaatttctactggggctggatccgccagcccccaggagagggctgcagtgattggagtctctattatagtgggaacacctactacaacccgtcctcaacggtcgagtcaccatatcgtggacacgtcgaggacacagttttcctgaaagtgagttctgtggcgcgccgacacggctgtctactactgtgtcagacatgggtccgcctatggcaggtcgtctcaattctactacgcttggacgtctgggccaaggaccacggtcaccgtctcctcatcctcagcctccacaagggcccatcggtcttccccctgcgccctgctccaggagcacctcgagagcacagcggccctggctgcctggtcaaggactacttcctatatactgtctgagcggctggcaaggcgcatag

SEQ ID NO: 791257 - DNA, 701 bp, Homo sapiens
  misc_feature: 27036.44.36.D03.1.pb.heavy.1.raw 27036
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggtttcaggttagtcattcgcagaatcaatgagttcttgaagtcatctcttgagagggtgaatctggcttcacagacgcggcgtactctgtgataaagctggcaactttgtttttactgcggccaagccactccagccccttccctggagcctggcggacccagtccatatagtggtcactgatggtgaatccagaggcgacacaggagagtctcaggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctgggctggggctccgctctcagagctccccaagagagatcgtgacgcagctaaatcgagcaccggtcgtgtatatactgtctgatggcgcgagggaggcgatacg

SEQ ID NO: 791258 - DNA, 722 bp, Homo sapiens
  misc_feature: 27051.44.85.H08.1.pb.heavy.1.raw 27051
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctcccccagactccaccagctgcacctgacactggacacctcttaaaagagcaacgaggaaaacccagctcagcccaaactccatggtgagtctctgtgttcagtgctgatcaccgaatggaaacaccgccggacttctagtgctgggctcctctcccagagctcccgcgactgagtgatactaaatcgagcaccggtcgtgtatatactgtctgatggcgcgagggaggcgatacg

SEQ ID NO: 791259 - DNA, 668 bp, Homo sapiens
  misc_feature: 27055.44.86.H09.1.pb.heavy.1.raw 27055
ctatgcgccttgccagcccgctcagacagtatataggaagtagtccttgaccaggcagcccagggccgctgtgccccagaggtgctcctggagcaggcgccagggggaaagaccgatgggcccttggtggaaggctgaggagacagtgaccagggtgccacgggccccatagattgaaagaccagtctcgcctcgcacagaaaataaacggccgtgtccgcggccggtcaacggaaggtcagtttcaggagaagcggcgttcattggacgtgtccctcgaaatggtgagacgactcttgagggacggagagtagtacgtcgccccagtataatggatgtcaccaatccactccaattcccctccctggggctgccggatccagccaagaatgatcagaactgatgaaaactcagagacaggtgcagatgagagacagggtttcccgaagcgcgctcaccagtcttgggcccgactcctgccagctgcacctgggagcaggaccatctggagctgccacagcaggaggaaaaaccacaggtggcttcatgttcttgcacaggaggttccttgactcttcagaaagcatccccaaaacccaagtctatagcactaaatcgagcaccggtcgtgtatatactgtctgatggcgcgcgagggaggcgatacg

SEQ ID NO: 791260 - DNA, 765 bp, Homo sapiens
  misc_feature: 27060.UNK.UNK.UNK.pb.heavy.1.raw 27060
cgtatcgcctccctcgcgccatcagacaagtattagtcacgcacacggtgctcgatttagagtgacgctcgttgggtttggggagctctgggagaggagcccagcaccagaagtcggcggtgtttccagtcggtgatcagcaccgaacacagaggactcaccatggagtttgggcctgacctgggtttttcctcgttgctcttttaagaaggtgtccagtgtcaggtgaaagctggtggaagtctgggggaaggcgtggtccagcctgggaggatccctgagacactctccctgtgtagcgcgtctggattcaccttcaacagacatggcatgcactgggtcgggcaggctccaggcaaacgggactggagtgggtggcacttataatatggtatgatggaagtaataaatatctatgtagattcccgtgaagggccgattcacatctccagagacaattcgaagaagacacacttattatctggaaatgaataggcctgagagccgaggacacggctgtctactaactgtgcgagagatggggggctcgtggatacagatatgacatgcttctactccaatggtattggacgcctggggccaaaagggaccactcggtcgccgtctcctcagcctcccaccaagggcccatcggtccttcccctggccacctcctccagagcccactctgggggcacagcggccctgggcgcctggtcaaggactacttcttatactgttctgagcggctggcaaggcgcatag

SEQ ID NO: 791261 - DNA, 576 bp, Homo sapiens
  misc_feature: 27082.44.53.E09.1.pb.heavy.1.raw 27082
cgtatcgcctccctcgcgccatcagacagtatatacacgaccggtgctcgatttagagagagtgtgttgggtttgggggaggcgtggtccagcccgggaggtccctgagactctcctgtgtagcctctgggtttctcattcgatagatttggtttgcactggtccgccaggctccaggcaaggggccggagtgggtggcagtcatctccgacgatggaagtgagaagtattactcagactccgtgaagggccgattcaccatctccagagacaattccaagaatatgctgtatttgcaaatgaacagcggtgagagttgacgacacgtctgtttattactgtgcgagggggacctccaaggaaacggttcggggaatcataaaactactactatttgatggatgtctggggcaggggggacgtcggtcaccgtctcctcagcttccaccaagggcccatcggtcttccccctggcgccctgctccaggagcacctctgggggcacagcggccctgggctgcctggtcaaggactacttcctatatactgtctgagcggggctggcaaggcgcatag

SEQ ID NO: 791262 - DNA, 702 bp, Homo sapiens
  misc_feature: 27087.44.27.C05.1.pb.heavy.1.raw 27087
ctatgcgccttgccagcccgctcagacagtatataggaagtagtccttgaccaggcagcccagggccgctgtgctctcggaggtgctcctggagcagggcgccagggggaagaccgatggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcaggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccaggcccaaacccttcgatcgcgtctaaatcgagcaccggtcgtgtatatactgtctgatggcgcgagggaggcgatacg

SEQ ID NO: 791263 - DNA, 606 bp, Homo sapiens
  misc_feature: 27091.UNK.UNK.UNK.pb.heavy.1.raw 27091
cccgacacgcttctagggacttggagctaagacgaacatatgctttagacagtcgaaggtgacgcctgacttaccactgaaacgtttaggcgccagatgcggtctgggatgacctaactcgcagcttatcgatgaatctactgcacgctcaagcaccaggtcttgatggcggcgcgataggactgacgggatcgctacagacatttaactcgctagtaacttaattgagatcctaggggatgggataggaaatagaatccacccctatcacccccccacataggcctgcttggggtgttgagtttacttttattttcgtgttggaatgagttgacttccgggaagtgggagtaatgggtttgtctacttccctaaccgcaaagtactagttttacgagtggcgttgcaagcatagccagtcacaggtaataaacaattcaacgtggcgtaaaagattggccgctgctgtgggcattgcaagctgggtttgcagcattgtgcatgctagacgacaatatgaatctgcggggacccctagtgccagatggccgctagcggttccgcagcttttgacctggaccagggtgcatagcctgcccagccttc

SEQ ID NO: 791264 - DNA, 703 bp, Homo sapiens
  misc_feature: 27096.44.9.A09.1.pb.heavy.1.raw 27096
ctatgcgccttgccagcccgctcagacagtatcatacggaagtagtccttgaccaggcagccagggccgctgtggctctcggaggtgctcctggagcagggcgccagggggaagaccgatgggcccttggtgggaggctgaggagacggtgaccaggggttccctggcccccagtagtcaagcgggaccgtctcgagggggctctcgcacaataatagacagccgtgtcctcacttgtgaggttgtacatttgcagatgcagtgtgttcctggaattgtcctctggagacggtgaatcggcccttctcggagtctccgtagtgtttcttcaattccatcttctgatataattgccacccactccagcccttgcctggagcctgggcggacccagtgcatggcataggtcctgaagatgaatccagaggctgcacaggagagtctcaggagttcccaggctgggccgctcctcccccagactccactagctgcacctgacactgggccacctcttaaaaaggcaacgaggaaaaacccatctcagcccaaagtccatggtgagtcctctgtgttcagtgattgatcaccgaatggaaacaccgcgacttccagtgctgggctcgttctcccccccctgcgcgtctcgctaaatcgagcaccggtcgtggtatatactgtctgatggcgcgagggaggcgatacg

SEQ ID NO: 791265 - DNA, 690 bp, Homo sapiens
  misc_feature: 27138.44.73.G07.1.pb.heavy.1.raw 27138
cgtatcgcctccctcccgcgccatcagacagtatatacacgaccggtgctcgatttagctctacgctcaggggggggagacgagcccagcactggaagtcgccggtgtttccattcggtgatcatcactgaacacagaggactcaccatggactttgggctgaggatgggttttcctcgttgctcttttaagaggtggccagtgtcaggtgcagctagtggagtctgggggaggagcggcccagcctggaactcctgagactctcctgtgcaggcctctggattcatcttcaggacctatgccatgcactgggtccgccaggctccaggcaaggggctggagtgggtggcaattatatcagaagatggaattgaagaacactacggagactccgagaagggccgattcaccgtctccagagacaattcaggaacacactgcatctgcaaatgtacaacctcacaagtgaggacacggctgtctattattgtgcgagagccccctcgagacggtcccgcttgactactggggccagggaaccctggtcaccgtctcctcagcctccaccaagggcccatcggtcttccctggcgccctgctcaggagcacctccgagagcacagcggcctgggctgcctggtcaaggactacttcctatatactgtctgagccggctggcaaggcgcatag

SEQ ID NO: 791266 - DNA, 672 bp, Homo sapiens
  misc_feature: 27192.UNK.UNK.UNK.pb.heavy.1.raw 27192
cgtatcgccttccccgcgccatcagcagtatatacacgaccgggtgctcgatttagatctactgacaaccacattcctcctctaaagagcccctgggagcacagctcatcaccatggactggacctggaggttcctctttgtggtggcagcagcaacaggtgtccagtccctggtgcaactggtgcagtctggactagaatgccgcaaccttggtcctcggtgaccctttcctgcacggcctctggaagtactaccagttccactacttataccatcaactgggtgcgccaggcccctggacaagggcttgagtggatggtggaatcatccctctttttggctcactcacctacgcacgagacttccggggcagaattacgattaccgcgggacaagtccacagacacagtctccatgacaatgagttctttgaaatccgacgacacggccgtctactactgtgcgagagtccgtaccccagctcgcatggagcctttgagatctgggggcagggaaccctggtcattgtcacctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 791267 - DNA, 572 bp, Homo sapiens
  misc_feature: 27205.44.78.H01.1.pb.heavy.1.raw 27205
cgtatcgcctccctcgcgccatcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 791268 - DNA, 620 bp, Homo sapiens
  misc_feature: 27211.44.38.D05.1.pb.heavy.1.raw 27211
cgtatcgcctccctcgcgccatcagacagtatatacacgaccggtgctcgatttagtatctgatagctgggtttttccttgttgctattttaaaaggtgtccagtgtgaggtgcagctggtggagtccggggaggcttagttccagcctggggggtccctgagactctcctgtgcagcctctggattcaccttcagtagctactggatgcactgggtccgccaagctccagggaaggggctggtgtgggtctcacgtattaatagtggatgggagtagcacaaagctacgcggactccgtgaaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaaggcccatcggtcttcccctggcgccctgctccaggagcacctctggggcacagcggccctgggctgcctggtcaaggactacttcctatatactgtctgagcgggctggcaaggcgcatag

SEQ ID NO: 791269 - DNA, 560 bp, Homo sapiens
  misc_feature: 27229.44.57.F02.1.pb.heavy.1.raw 27229
cgtatcgcctccctcgcgccatcagacagtatatacacgaccggtgctcgatttagctcgatatagttgggtttgggctgaggtgaagaagcctgggcctcagtgaaggtttcctgcaaggcttctggatacaccttcaatatttatgctatgcagtgggtgcgccaggccccggacaaagcttgagtggatgggatggatcaacgctggcaatggtgacacaagatattcacagaagttccagggcagagtcaccattaccagcgacacatccgcgagcacagcctacatggagctgagcagcctgagatctgaagacacggctgtatattattgtgcgagagaagggggaatgactacggtaactacctctattactactacatggacgtctgggcgaagggaccatggtcaccgtctcctcagcctccaccaagggcccatcgtcttccccctggcgccctgctccaggagcacctccgagagcacagggccctggctgcctggtcggtcaagactacttcctatatactgtctgagcgggctggcaaggcgcatag

SEQ ID NO: 791270 - DNA, 643 bp, Homo sapiens
  misc_feature: 27230.44.23.C01.1.pb.heavy.1.raw 27230
cgtatcgcctccctcgcgccatcagacagtatatacacgaccggtgctcgatttagtacacgtgattagggattgggggctttctgagagtcaaggacctcctgtgcaagaacatgaagcacctgtggtttttcctcctgctgtggcagctcccagatgggtcctgtcccaggtgcagctgcaggagtcgggcccaggactggtgaggccttcggaaccctgtctctcatctgcactgtctctggagtttccatcagttctgatcattcttggggctggatccgcagccccagggaggggaatggagtggattggtgacatccattatactggggcgacgtactactctccgtcctcaagagtcgtctcaccatttcgagggacacgtccatgaaccgcttctcctgaaactgacctccgtgaccgccgcggacacggccgtttatttctgtgcgaggcgagactggtctttcaatctatggggccgtggcaccctggtcactgtctcctcagcttccaccaagggcccatcggtcttcccctggcgccctgctccaggagcacctctggggcacagcggccctggctgcctggtcaaggactacttcctatatactgtctgagcggctggcaaggcgcatag

SEQ ID NO: 791271 - DNA, 606 bp, Homo sapiens
  misc_feature: 27241.UNK.UNK.UNK.pb.heavy.1.raw 27241
gaaggctgggcaggctatgcaccctggtccaggtcaaaagctgcggaacccgctagcggccatcttggccactaggggtcccgcagattcatattgtcgtctagcatgcacaatgctgcaaaccccagcttgcaatgcccacagcaagcggccaatcttttacgccacgttgaattgtttttacctgtgggactggctatggcttgcaacgccactcgtaaaactagtactttgcggttaggggaagtagacaaacccattactccacttcccgggaagtttcaactcatccaacacgataaaagtaaactcacaccccaagcaggcttgtgggggggtgataggggtggattctatttcctatccctcccctaggatctcaattaattactagcgagttaaatgtctgtagcgatcccgtcagtcctatccgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaaatgtcgtccttagctccaagtccctagcagcgtgtcgggt

SEQ ID NO: 791272 - DNA, 711 bp, Homo sapiens
  misc_feature: 27256.UNK.UNK.UNK.pb.heavy.1.raw 27256
ccgtatcgcctcctcgcgccatcagacagtatataccacgaccgcgggtgctcgatttagctctacgctcaggggggagacgagcccagcactggaagtcgccggtgtttccattcggtgatcatcacttgaacacagaggactcaccatggactttgggctgagatgggttttcctcgttgcctcttttaagaggtggccagtgtcaggtgcagctagtggagtctgggggaggagcggcccagcctgggaactccctggagactctcctgtgcagcctctggattcatcttcaggacgctatgccgatgcactgggtccgccaggctccaggcaaggggcctggagtcgggtggcaattatatcagaagatggaattgaagaacactacggagactcgagaagggccgattcacgcgtctcagagacaattccaggaacacactgcattctgcaaaatgtacaaacctcacaagtgagggacacggctggtctattattgtgcgagagcccctcgagacggtcccgcttgactactgggggccagggaaccctggtcaccgtctctccagcctccaccaaaggcccatcggtcttcccctgggcgcccctgctccaggagcacctccgagagcacagcggcccctgggctgccctggtcaaggacttaacttcctatatactgtctgagcgggctggcaaggcgcatag

SEQ ID NO: 791273 - DNA, 708 bp, Homo sapiens
  misc_feature: 27263.UNK.UNK.UNK.pb.heavy.1.raw 27263
ctatgcgccttgccagcccgctcgacagtatataggaagtagtccttgaccaggcagccagggccgctgtggctctcggaggtgctcctggagcagggcgccagggggaagaccgatgggcccttggtggaggctgaggagacggtgaccagggttccctggccccagtggacagttcctgataaaacacaacacaataatacatgcccgtgtctcggttttcaggttagtcattcgcagaatcaatgagttcttgaagtcatctctttgagagggtgaatctggctttcacagacgcggcgtactctgtgattaaagctggcaactttgtttttactgcggccaagccactccagcccccttccctggagcctggcggacccagtccatatagtggtcactgatggtgaatccagaggcgacacaggagagtctcagggaccctccaggctggaccaagtctcccccgactcccaccactgcacttcactctggacaccgcttgtaaaataacaacaaggaaaacccgctcagcccgaactccatggtgagtcctctgtgttcagtgctgatcaccaatgaaaacacctgggaattctggggctggggctccgctctcagagctccccaagagagatcgtgacgcagctaaaatcgagcaccgcggtcgtgtatatactgtctgatggcgcgaagggaggcgatacg

SEQ ID NO: 791274 - DNA, 702 bp, Homo sapiens
  misc_feature: 27268.44.55.E11.1.pb.heavy.1.raw 27268
cgtatcgcctccctcgcgccatcagacagtatatacacgaccggtgctcgatttagcactcgcacgtttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctggctcacgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgactttctggggccagggaacctggtcaccgtcgcctccgcctccaccagggcccatcggtcttccccctggcaccctcctccaagagcacctctgggggcacagcggccctgggctgcctggtcaggactacttcctatatactgtctgagcggctggcaaggcgcatag

SEQ ID NO: 791275 - DNA, 697 bp, Homo sapiens
  misc_feature: 27284.44.55.E11.1.pb.heavy.1.raw 27284
ctatgcgccttgccagcccgctcagacagtatataggaagtagtccttgaccaggcagcccaggccgctgtgcccccagaggtgctcttggaggagggtgccaggggaagaccgatggcccttggtgaggcggaggcgacggtgaccagggttccctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagcccttccctggagcctggcggacccaactcatgtagttgctgctgacggtgagcccagaggctgcacaggagagtctctggaccccccaggctggactaagcctcctccagactccatcagccgcacctcacactggacaccttttaaaagtccaacaaggagaaccagctcagccaaaactccatggtgagtcctctgtgttcagtgctgatcaccgaatggaaacacctcggaatccagtgctgggctcctctcccccccaaacccaacgtgcgagtgctaaatcgagcaccggtcgtgtatatactgtctgatggcgcgagggaggcgatacg

SEQ ID NO: 791276 - DNA, 706 bp, Homo sapiens
  misc_feature: 27305.44.36.D03.1.pb.heavy.1.raw 27305
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacgatgaccagggttccctggccccagtggacagttcctgatataaacacaacacaataatacatgcccgtgtcctcggttttcaggttagtcattcgcagaatcaatgagtttcttgaagtcatctcttgagagggtgaatctggctttcacagacgcggcgtactctgtgataaagctggcaactttgtttttactgcgccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaaacccagctcagcccgaactccatggtgagtcctctgtgttcagtgctgatcaccaaatgaaaacacctgggaattctggggctggggcccgctctcagagctccccaagagagatcgtgacgcagctaaatcgagcaccggtcgtgtatatactgtctgatggcgccgagggaggcgatacg

SEQ ID NO: 791277 - DNA, 667 bp, Homo sapiens
  misc_feature: 27307.44.12.B01.1.pb.heavy.1.raw 27307
cgtatcgcctccctcgcgccatcagacagtatatacacgaccggtgctcgatttagtagtgtagattccgcgggctttctgagagtcatggacctcctgtgcaagaacatgaagcacctgtggttcttcctcctgctggtggcggctcccagatggggtcctgtcccagctgcagctgcaggagtcgggcccaggactggtgaagccttcggagaccctgtcccctcacctgcactgtctctggtggctccattcagcagttagtagttactacctggggctggatccgccagcccccagggaaggggctggagtggatgggggagtatctattatagtgggagcacctactacaaccgtccctcaaggtcgagtcaccatatcagtagacacgtccaagaaccagttcttcccttgaaggctgagctctgtgaccgccgcggacacggccgtgtattactgtgcgagagtgggcagttcgtcaccaactacttggaccactggggccgggaccctggtcaccgtctcctcagccccaccagggcccatcggctcccccctggcaccctcctccaaagagcacctctggggcacagccgcggccctgggctgcctggtcaaggactacttcctatatactgtctgagcgggctggcaaggcgcatag

SEQ ID NO: 791278 - DNA, 715 bp, Homo sapiens
  misc_feature: 27319.44.56.F01.1.pb.heavy.1.raw 27319
cgtatcgcctcctcgcgccatcagacagtatatacacgaccggtgctcgatttagcagacgtctgaacaccaccaaaggggctgggagaggagccccagccgtggagattcccaggagtttccacttggtgatcagcactgagcacagaccaccaaaccatggagtttgggctaatcttgatttccttgtagttttttttagaaggtgtccagtgcgaggggcgactggcggagtcggggggggcttggcacagccagggcggtctctgagacctctcctgtgtagctcaggattcagtcttagtgattatcactttggcctggtccgtcaaggctccagggaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagaacccgacgaacacaggcgtctattactgcgccagggcgatcctggacgtcgatgcatttgatatttggggccaggggacaatggtcaccgtctcttcagcttccaccaagggcccatcggtcttcccctggcgccctgctccaggagcacctctggggccacagcggccctgggctgcctggtcaaggactacttcctatatactgtctgagcgggctggcaaggcgcatag

SEQ ID NO: 791279 - DNA, 705 bp, Homo sapiens
  misc_feature: 27344.44.55.E11.1.pb.heavy.1.raw 27344
cgtattcgcctcctcgcgccatcagacagtatatacacgaccggtgctcgatttagcactcgcacgttggttttgggagaggagccagcactgggattccgaggtgtttccattcggtgatcagcactgaacacagagactcaccatggagttttggctgagctgggttctcctttgttggacttttaaaaggttgtccagtgtgaggtgcggctgatggagtctggaggaggcttagtccagcctggggggtcccagagactctcctgtgcagcctctgggctcaccgtcagcagcaactacatgagttgggttccgccaggctccagggaaggggctggagtgggtctcagtcatttatactggtgattttcacatactacgcagactccgtgaagggccgattcaccatctccagggacaattccaggaacacggtttatcttcaaatgaacaacctgagaggcgacgaacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 791280 - DNA, 705 bp, Homo sapiens
  misc_feature: 27379.44.73.G07.1.pb.heavy.1.raw 27379
cgtatcgcctccctcgcgcatcagacagtatatacacgaccggtgctcgattagctctacgctcaaggggagctctgggagaggagcccagcactagaagtcggcggtggttttccattcggtgatcagcactgaacacagaggactcaccatggagtttgggctgagctggttttccctcgtactcttttaagaggtgtccagtgtcaggtgcacctggtggagtctgggggaggcgtggtccagcctggaggtccctgagactctcctgtgaagcctctggatttagtttcagtagttctggcatgcactggggtccgccaggctccaggcaagggccggagtggttggcagttatagcatatgatggaaccttctagatattatgcagactccgtgaagggccgattcaccatctccagagacaattcccggaacactcgtgtacctggaaatgatcagctgagaggcgaggactcggctctgctttactgtgcgagatcggaagtggcacagctatatcgggcgtttcactggggccaggggacactgggtcaccgtctcctcaggcctccaccaagggcccatcggtcttccccctggcgccctgctccaggagcacctccgagagcacagcggccctgggctggcctggtcaaggactacttcctatatactgtctgagcgggctggcaaggcgcatag

SEQ ID NO: 791281 - DNA, 716 bp, Homo sapiens
  misc_feature: 27382.UNK.UNK.UNK.pb.heavy.1.raw 27382
cgtatcgcctccctcgcgccatcagacagtatatacacaccggtgctcgatttagcaccggggcggggtttgggggggagaggagcccagcactgggattccgaggtgtttccattcgtgatcagcacggaacacagaagacctcacccatggagttttggctgagctgggttctccttgttgacttttaaagccggtgtccagtgtgaggtgcgggctgatggaggtctggagggaggcttagtccagccctgggggtccgcagagactctcctgtgcagcctctgggctcaccgtcagcagcaactacatgagttgggtccgccaggctccagggaaggggctggagtgggtctcagtcattttatactgtggattttcacatactacgcagactccgtgaagggccgattcaccatctccaggggacaattccaggaacacggtttatcttcaaatgaacaacctgagagcgacgacacggccgtctattactgtgcgagacaagtcggcgctcggagtggttattatttcgtttgaccttctggggcagggaaccctggtcaccgtccgcctccgcctccaccaagggcccatcggtcttccccctggcacccctcctccaagagcacctctgggggcacagcggcccctggctggcctggtcaaggactacttcctatatactgtctgagcgggctggcaagggcgcatag

SEQ ID NO: 791282 - DNA, 711 bp, Homo sapiens
  misc_feature: 27398.UNK.UNK.UNK.pb.heavy.1.raw 27398
ctatgcgccttgccagcccgctcagacagtatataggaagtagtccttgaccaggccagcccagggccgctgtgcccccagaggtgctcttggaggagggtggccagggggaagaccgatgggcccttggtggaggcgggaggcgacggtgaccagggttccctggccccagaagtcaaacgaataataaccactccggagcgccgacttgtctcgcacagtaatagacggccggtggtcgtcgcctctcaggttgttcatttgaagataaaccgtgttcctggaattgtccctggagatggtgaatcggcccttcacggagtctgcgtagtatgtgaaatcaccagtataaatggactgagacccactccaggccccttcctggaggcctggcgggaccaactcatgtagttgctgctgacggtgagcccagaggctgcacaggagagtctctgggaccccccaggctggactaagcctccctccagactccatcagccgcacctcacactggacaccttttaaaagtccaacaaggagaaccccagctcagcaaaactccatggtgagtcctctgtgttcagtgctgatcaccgaatgaaacacctcggaatccagtgctgggctcctctccccaaacccaacgtgcgagtgctaaatcgagccaccggtcgtgtatatactggtctgatggcgcgaggaggcgatacg

SEQ ID NO: 791283 - DNA, 673 bp, Homo sapiens
  misc_feature: 27399.44.45.E01.1.pb.heavy.1.raw 27399
cgtatcgcctccctcgcgccatcagacagtatatacacgaccggtgctcgatttagtgagtcagtaaggaaaggggctgggagaggagcccagcactagaagtcggcggtgtttccattcggtgatcagcactgaacacagaggactcaccatggagtttgggctgagctgggtttcctcgttgctcttttaagaggtgtccagtgtcaggttcagctggtggagtctggggaggcgtgtccagcctgggacgtccctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgattctccgtctccagagacaattccaagaacaccgtgtatctacaaatgaacaatttgagagcgaggactcggctctctattattgtacgagcccatcgttctactgggccagggagccctggtcaccgtctcctcagcctccaccaagggccatcgtcttcccctggcgccctgctccaggagcacctccgagagcacagcggccctgggctgcctggtcaaggactacttcctatatactgtctgagcggctggcaaggcgcatag

SEQ ID NO: 791284 - DNA, 718 bp, Homo sapiens
  misc_feature: 27403.44.85.H08.1.pb.heavy.1.raw 27403
cgtatcgcctccctcgcgccatcagacagtatatacacgaccggtgctcgatttagtatcactcagtcgcgggagctctggagaggagcccagcactagaagtcggcggtgtttccattcggtgatcagcactgaacacagaggactcaccatggagtttggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaatgaacagcctgagagccgaggacacggctgtgtattactgtgcgaggacatattgtagtactaccacctgctgggactactactacggtatggacgtctggggccaagggaccacggtcaccgtctcctcagcctccaccaagggcccatcggtctccccctggcaccctcctccaagagcacctctgggggcacagcggccctgggctgcctggtcaaggactacttcctatatactgtctgagcgggctggcaaggcgcatag

SEQ ID NO: 791285 - DNA, 684 bp, Homo sapiens
  misc_feature: 27405.44.33.C11.1.pb.heavy.1.raw 27405
taggaagtagtccttgaccaggcagccaggccgctgtgccccagaggtgctcttggaggagggtgccagggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcgctctcaggctatcatttccagatatagtgtgttctcgaatgtctctggagatggtgaatcggccttcacggaatctacatatatttattacttccatcataccatataagtgccacccactccagtccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagccaaactccatggtgagtcctctgtgttcggtgctgatcaccgactggaaacaccgccgacttctggtgctgggctcctctcccagagctccccaaacccaacgagctcactctaatcgagcaccggtcgtgatagtatagactgatggcgcgaggaggcgatacg

SEQ ID NO: 791286 - DNA, 603 bp, Homo sapiens
  misc_feature: 27406.UNK.UNK.UNK.pb.heavy.1.raw 27406
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccggaagtggagtaatggtttgtctacttcccctaaccgcaaagtactagttttacgagtggcgttgcaagcatagccagtcacaggtaataaacaattcaacgtggcgtaaagattggccgcttgctgtgggcattgcaagctgggtttgcagcattgtgcatgctagacgacaatatgaatctgcgggaccctagtggccaagatggccgctagcggttccgcagcttttgacctggaccagggtgcatagcctgcccagccttc

SEQ ID NO: 791287 - DNA, 616 bp, Homo sapiens
  misc_feature: 27413.44.23.C01.1.pb.heavy.1.raw 27413
cgtatcgcctcctcgcgccatcagacagtatatacacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcggaaccctgtctctcatctgcactgtctctggagtttccatcagttctgatcattcttgggctggatccggcagcccccagggaggggaatggagtggattggtgacatccattatactggggcgacgtactactctccgtccctcaagagtcgtctcaccatttcgaggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttcccctggcgccctgctccaggagcacctctgggggcacagcggccctggctgcctggtcaaggactacttcctatatactgtctgagcgggctggcaaggcgcatag

SEQ ID NO: 791288 - DNA, 697 bp, Homo sapiens
  misc_feature: 27448.44.74.G08.1.pb.heavy.1.raw 27448
cgtatcgcctccctcgcgccatcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaaacaggtgtccagtccctggtgcaactggtgcagtctgggactagaatgccgcaaccttggtcctcggtgaccctttcctgcacggctctggaagtactaccagttccactacttataccatcaactgggtgcgccaggcccctggacaagggcttgagtggatgggtggaatcatccctctttttttggctcactcacctacgcacgagacttccgggcaagaaattacgattaccgcggacaagtccacagacacagtctccatgacaatgagttctttgaaatcgacgacacggccgtctactactgtgcgagaggtccgtaccccagctcgcatggagcctttgagatctggggggcagggaaccctggtcattgtcacctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 791289 - DNA, 711 bp, Homo sapiens
  misc_feature: 27452.UNK.UNK.UNK.pb.heavy.1.raw 27452
ctaatgcgccttgcccagcccgctccagacagtatataggaagtagtccttgaccaggcagcccagggccgctgtgcccccagaaggtgctcttggaggagggtgccagggggaagaccgatgggcccttggtggaggcggaggcgacggtgaccagggttcctggccccagaagtcaaacgaaataataaccactccgagcgccgacttgtctcgcacagtaatagacggccgtgtcgtcgcctctcaggttgttcattttgaagataaacccgtgttcctggaattgtccctggagatggtgaatcggcccttcacggagtctgcgtagtatgtgaaatcaccagtaataaaatgactgagacccccactccaagccccttccctggagcctggcggacccaactcatgtagttgctgctgacggtgagcccagaggctgccacaggagagtctctgggacccccaggctggactaagcctcctccagactccatcagccgcacctcacactggacaccttttaaagtccaacaaggagaacccagctcagcaaaactccatggtgagtcctctgtgttcagtgctgatcaccgaatggaaacacctcggaatcccagtgctgggctcctctccccaaacccaacgtgcgagtgctaaatcgagcacggtcgtgtatatactgtctgatggcgcgagggaggcgatacg

SEQ ID NO: 791290 - DNA, 680 bp, Homo sapiens
  misc_feature: 27457.UNK.UNK.UNK.pb.heavy.1.raw 27457
cgtatcgccctccctcgcgccatcagacagtatatacacggaccggtgctcgatttagcacacgatagttgggtttggggatactttctgagactcatgggccctctgcacaagaaacatgaaacacctgtggttcttcctcctcctggtggcacctcccagatggggtcgtgtccgaggtgcagctgcaggagtcgggccaggacgggtgaagccttcggagaccctgtccctcacctgcaatgtctctggtggttacatcagtagttattattggagttggctgcggcagtccgccgggaagggactggagtggattgggggcatctataacagtggcagcaccaactacaacccccgccctcaagagtcgagtcaccatgtcactagacaggtccaagaaccagttctccctgaaattgacttctgtgaccgccgcggacacggccgtatattatgttgcgagaggattcctatcgattacagtagagacgggggggcgaactggctcgaccctggggccaggaaccctggtcaccgtctcctcagcctccaccaagggccatcggtcttccccctggcaccctctccaagagcacctctggggacacagcggccctgggctgcctggtcaaggactactcctatatactgtctgagcgggctggcaaggcgcatag

SEQ ID NO: 791291 - DNA, 617 bp, Homo sapiens
  misc_feature: 27516.UNK.UNK.UNK.pb.heavy.1.raw 27516
ctatgcgccttgccagcccgctcagacagtaatataggaagtagtccttgaccaggcagcccaggcgctgtgccccagagggctgcagggccggagccggtggcccttggtgaagctgaggtgacatgaccaggtccctgcccccagattcaaaggctgacactggtacgaccgaggttacgccgtgtcgtcggatcaaagaactcattgtcatggagactgtgtctgtggttgtccgcgtaatcgtaattctgcccggtctcgtgcgtagtgagtgagccaaaagagggatgattccaccatccactcaagccttgtcagcctgcgcacccagttgatggtataagtagtggaactggagtacttcaaggcgtgcagaaaggtcaccgagacaagttgcgcattctagtccagactgcacagttgcaccagggactggacactgttgctgctgccacacaaagaggaacctccaggtccagtccatggtgatgagctgtgctcagggcttcttagaggaggaatgtggttgttatgtgatgctcccctgatagagctactaaatcggagcaccggtcgtgtatatactgtctgatggcgcccgaggaggcgatacg

SEQ ID NO: 791292 - DNA, 541 bp, Homo sapiens
  misc_feature: 27518.44.43.D10.1.pb.heavy.1.raw 27518
ctatgcgccttgccagcccgctcagacagtatataggaagtagtccttgaccaggcagcccagggccgctgtgcccccagaggtgctcctggagcagggcgccaggggaagaccgatggcccttggtggaagctgaggagacggtgaccagggttccctggccccagggtcgaaccacctccccgacgagctgctatactttcgggatctcgcacagtaatacacggccgtgtcctcagatctcaggctgctcagctccatgtaggctgtgtttatggaggtgttcctggtcatggtgactctgcctggaacttctgtgcatagcctgtgttaccactgttagggttcatccatcccatccactcaagcccttgtcagtggcctgtcgcacccagttgatatcataatggtgaaggtgtatccagaagccttgcaggagacctcactgaggcccaggcttcttcacctcagccccttactgctagtctaaatcgagcaccggtcgtgtatatactgtctgatggcgcgaggaggcgatacg

SEQ ID NO: 791293 - DNA, 572 bp, Homo sapiens
  misc_feature: 27548.44.78.H01.1.pb.heavy.1.raw 27548
cgtatcgcctccctcgcgccatcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatggatggatgaagccctatagtggcaacacgggctttgcccagaagttccaaggcagagttagtatgaccaggagcacctcccaggtacagtctacatggaactgagcagcctgagatctgaggaacacggccgtgtatttctgtgcgagagccacccagcacctggcttgacttgtggggccagggaacctggtcaccgtctcctcagcctccaccaagggcccatcggtcttcccctggcgcctgctccaggagcaacctccgagagcacagcggccctgggctgcctggtcaaggactacttcctatatactggtctgagcgggctggcaaggcgcatag

SEQ ID NO: 791294 - DNA, 700 bp, Homo sapiens
  misc_feature: 27568.44.62.F07.1.pb.heavy.1.raw 27568
cgtatcgcctccctcgcgccatcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggcttttttaaagggtgtcgtgtgtgaagtgcagttgttggagtctggggggggcctgattcggcctgggaggtccctgaccctctcctgtgcggccctctggattcacctttagtgcctatggcatgacctgggtccgccgggctccagggaggggactggagtgggtctcaagtatcggagctggtggtgtcactttctacggagactccgtgaagggccgcttcaccatttccagggacaattcgcaggacaaattgtttctccaaatgaaaaacctgagacccgaggacacaggcgtctattactgtttgaaagccaggaccacggtgaccccccatgacacctttagtacttggggccgggggacagtggtgaccgtctcttcagcctccaccaagggcccatcggtcttccccctggcgccctgctccaggagcacctccgagagcacagcggccctgggctgcctggtcaaggactacttcctatatactgtctgagcgggctg

SEQ ID NO: 791295 - DNA, 598 bp, Homo sapiens
  misc_feature: 27588.44.23.C01.1.pb.heavy.1.raw 27588
cgtatcgcctcctcgcgccatcagacagtatatacacgaccggtgctcgatttagtacacgtgattagggattggggcagggggaacacctgtggttttttctcctgctggtggcagctccagatgggtccgtcccggtgcagctgcaggagtcggcccagactgtgaggcctcgggaaccctgtctctcatctgcacctgtctctggagtttccatcagtctgatcattctggggctggatcggcagccccagggaggggaatggagtgattggtgacatccattatactggggcgacgtactactctccgtcccttcaagagtcgttcaccatttcgagggacacgtccatgaccgcttctccctgaaactgactccgtgacgccgcgacacggccgtattctgtgcgaggcgagactgtctttcaattatggggccgtgcaccctggtcactgtctcctcagcttccaccaagggcccatcggtcttccccctggcgccctgctccaggagcacctctgggggcacagcggccctgggctgcctggtcaagactacttcctatatactgtctgagcgggctggcaaggcgcatag

SEQ ID NO: 791296 - DNA, 719 bp, Homo sapiens
  misc_feature: 27664.UNK.UNK.UNK.pb.heavy.1.raw 27664
ctatgcgccttgccagcccgctcagacagtatataggaagtagtccttgaccaggcagcccagggccgctgtgcccccagaggtgctcctggagcagggcgccagggggaagaccgatgggcccttggtggaagctgaagagacggtgaaccattgtcccctggcccaaatatcaaatgcatcgacgtcccaggatcgcctggcgcagtaatagacgcctgtgtcgtcgggtctcaggttgctcatttgtaaatgaacaacactgtttggagtcatccccttgagacggtgaatcttcccttcacagacgcggcgtactctttacttccaccataaacgtttcattctgacgaaagtgatccactcaagccccttccctggaggcctgacggacccaggccaagtgataatcactaagactgaatcctgagactacaacaggagagtctccagagaccgcctggctgtgccaagccccccccgactccgccagtcgcccctcgcactggacaccttctaaaaaaactacaaggaaaatcaagattagcccaaactccatggttggtggtctgtgctcagtgctgatcaccaagtggaaactcctggggaatctcacggctggggctcctctccagagctccccttgtgtgttcagacgtctgctaaatcgagcacccggtcgtgtatatactgtctgatggcgcgagggaggcgatacg

SEQ ID NO: 791297 - DNA, 608 bp, Homo sapiens
  misc_feature: 27772.UNK.UNK.UNK.pb.heavy.1.raw 27772
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacacccaagcaggctatgtgggggggtgataggggtggattctatttcctatcccatccccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 791298 - DNA, 602 bp, Homo sapiens
  misc_feature: 27825.UNK.UNK.UNK.pb.heavy.1.raw 27825
gaaggctgggcaggctatgcaccctggtccaggtcaaaagctgcggaaccgctagcggccatcttggccactagggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttagggaagtagacaaacccattactccacttcccggaagttcaactcattccaacacgaaataaaagtaactcaacacccaagcaggctatgtgggggggtgataggggtggattctatttcctatcccatcccctaggatctcaattaagttactagcgagttaaatgtctgtagcgatccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 791299 - DNA, 583 bp, Homo sapiens
  misc_feature: 27832.UNK.UNK.UNK.pb.heavy.1.raw 27832
cccgacacgcttgctaggactggagctaaggacgacatattgcctttagacagtcgaaggtgacgccttagctaccactgaacgttaggcgccagatgcggtctgggatgacctaactcgcagcttatcgatgatctactgcacgctcacaaaccaggtcttgatgcgccgcgataggactgacggatcgctacagacatttaactcgctagtaactaatgagatcctaggatggataggaatagaatccacccctatcacccccccacatagcctgcttggggtgttggtttactttattcgtgtggatgagttgacttccgggaagtggagtaatgggtttgtctactcccctaaccgcaaagtactagttttacgagtggcgttgcaagccatagccagtcacagtaataacaattcacgtggcgtaaagattggccgcttgctgtggcattgcaagctgggttgcagcattgtgcatgctagacgacaatatgaatctgcgggacccctagtggccaagatggcgctagcggttccgcagcttttgactggaccagggtgcatagcctgcccagccttc

SEQ ID NO: 791300 - DNA, 668 bp, Homo sapiens
  misc_feature: 27835.UNK.UNK.UNK.pb.heavy.1.raw 27835
cgtatcgcctccctcgcgccatcagacagtatatacacgaccgtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcggtgcaattcgtggagtctgggggaggcgtggccccagtagggggggttccctgagactctcctgtgcagcctctggattcaccttcgataattggaatatgcagtgggtccgcccaggctccaggcgagggctggagtgggtggcaggtgtgtcatttcatggaggaaatcaagtctacggtgattccgtgagggccgattcaccatctccagagaacattccgagaacacagtgtctcttcaatgaacagcctgagacctcaggacacggccgtgtatttttgtgcgagactatctgtttccaaaatcggttcattcgacgcctggggccagggaaccctggtcaccgtctcctcgcctccaccaagggcccatcggtcttccccctggccccctgctccaggagcacctccgagagcacagcggccctggctgcctggtcaaggactacttccta

SEQ ID NO: 791301 - DNA, 711 bp, Homo sapiens
  misc_feature: 27844.44.56.F01.1.pb.heavy.1.raw 27844
ctatgcgccttgccagcccgctcagacagtatataggaagtagtccttgaccaggcagcccagggccgctgtgcccccagaggtgctcctggagcagggcgccaggggaagaccgatgggcccttggtggaagctgaagagacggtgaccattgtcccctggccccaaatatcaaatgcatcgacgtcccaggatcgcctggcgcagtaatagacgcctgtgtcgtcgggtctcaggttgctcatttgtaaatggccaacactgttggagtcatccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagccccccccgactccgccagtcgcccctcgcactggacaccttctaaaaaactacaaggaaaatcaagattagcccaaactccatggttggtggtctgtgctcagtgctgatcaccaagtggaaactcctgggaatctcacggctggggctcctctcccagagctcccctttgtgtgttcagacgtctgctaaatcgagcaccggtcgtgtatatactgtctgatggcgcgagggaggcgatacg

SEQ ID NO: 791302 - DNA, 701 bp, Homo sapiens
  misc_feature: 27870.44.67.G01.1.pb.heavy.1.raw 27870
cgtatcgcctccctcgcgccatcagacagtatatacacgaccggtgctcgatttagagtatacatattgggtttggggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaagggctgagtgggtctcagtcatttatactggtgatttcacatactacgcagactccgtgaaggccgattcacatctccagggacaattccaggaacacggtttatcttcaaatgaacaacctgagaggcgacgacacggccgtctattactgttgcgagacaagtcggcgctcggagtggttattattcgtttgacttctggggccagggaaccctggtcaccgtcgcctccgcctccaccaagggccatcggtcttcccctggcaccctcctccaagagcacctctgggggcacagcggccctggctgcctggtcaaggactacttcctatatactgtctgagcgggctggcaaggcgcatag

SEQ ID NO: 791303 - DNA, 656 bp, Homo sapiens
  misc_feature: 27874.44.23.C01.1.pb.heavy.1.raw 27874
ctatgcgccttgccagcccgctcagacagtatataggaagtagtccttgaccaggcagcccagggccgctgtgcccccagaggtgctcctggagcagggcgccagggggaagaccgatgggccctggtggaagctgagggagacagtgaccagggtgcccacggccccatagattgaaagaccagtctcgcctcgcacagaaataaacggccgtgtccgcggcggtcacggaggtcagtttcagggagaagcggttcatggacgtgttccctcgaaatggtgagacgactcttgagggacggagagtagtacgtcgccccagtataatggatgtcaccaatccactccattcccctccctgggggctgccggatccagccccaagaatgatcagaaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagccccaatccctaatcacgtgtactaaatcgagcaccggtcgtgtatatactgtctgatggcgcgagggaggcggatacg

SEQ ID NO: 791304 - DNA, 707 bp, Homo sapiens
  misc_feature: 27889.UNK.UNK.UNK.pb.heavy.1.raw 27889
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctggggacccccaggctggactaagcctcctccagactccatcagccgcacctcacactggacaccttttaaaagtccaacagggagaacccagctcagccaaaaactccatggtgagtcctctgtgttcagtgctgatcaccgaatggaaacacctcggaatcccagtgctgggctcctctccccccccaaacccaacgtgcgagtgctaaatcgagcaccgtcgtgtatatactgtctgatggcgcgagggaggcgatacg

SEQ ID NO: 791305 - DNA, 692 bp, Homo sapiens
  misc_feature: 27895.UNK.UNK.UNK.pb.heavy.1.raw 27895
cgtatcgcctccctcggccatcagacagtatatacacgaccggtgctcgattttaagtacacgtggattagggatttggggggcttttctggagagtcaaggacctcctgtgcaagaaaacatgaaagcacctgtggtttttcctcctgctggtggcagctcccagaatgggtcctgtcccagggcagctgcaggagtcgggggccaggactggtgaggccttcgggaaccctgtctctcatctgcactggtctctggagtttccatcagttttctgatcatttctttggggctggatccggcagcccccagggagggggaatggagtggattggtgacatccattatactgggggcgacgtactactctccgtccccttcaagagtcgtctcaccatttccgagggacacgtccatgaaccgctttcttccctgaaactgacctccgtgaccggccggcggaacacgggccgtttatttctgtgcgaggcgagactgggtctttcaatctatgggccgtggcaccctgggtccactgttctccctcagcttccaccaagggcccatcggtcttccccctggcgcccctgctccaggagcacctctgggggccacagcggccctggggctgcctgggtcaaggactacttcctattatacgtctgagcgggctggcaaaagggcggcataaa

SEQ ID NO: 791306 - DNA, 720 bp, Homo sapiens
  misc_feature: 27964.44.36.D03.1.pb.heavy.1.raw 27964
cgtatcgcctccctcgcgccatcagacagtatatacacgaccggtgctcgatttagctgcgtcacgatctctcttggggagctctgagagccggagccccagccccagaatttcccaggtgttttcatttggtgatcagcactgaacacagaggactcaccatggagttcgggctgagcctggggtttccttgttgttattttacaaggtgtcccagagtgaagtgcagttggtggagtccggggggagacttggtccagcctggagggtccctgagactctcctgtgtcgcctctggattcaccatcagtgaccacctatatggactgggtccgccaggctccaggggaaggggctggagtggcttggccgcagtaaaaacaaagttgccaggctttatcacagagtacgccgcgtctgtgaaagccagattcaccctctcaagagatgacttcaagaactcattgattctgcgaatggactaacctgaaaaccgaggacaccgggccatgtattattgtgttgtgtttatatcaggaactgtcccactggggccagggaacccctggtcaccgtctcctcagcctccaccaagggcccatcggtcttcccctggcgccctgctccaggagcaccctccggagagcacaagcggccctgggctgcctggtcaaggactacttcctatatactgtctgagcgggctggcaaggcgcatag

SEQ ID NO: 791307 - DNA, 575 bp, Homo sapiens
  misc_feature: 27968.44.78.H01.1.pb.heavy.1.raw 27968
ctatgcgcctttgccagcccgctcagacagtatataggaagtagtccttgaccaggcagcccagggccgctgtgctctcggaggtgctcctggagcagggcgccagggggaaggaccgatgggcccttggtggaggctgaggagacggtgaccagggttccctggccccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatccccatccactccagcccttgtccagcggcctgtcgcacccagttaatatcataatgatgaacgtgtatccagaagccgtgcaggagactgtcactgaggcccaggcttcttcacctcagcagcgtggtgaccgtgacctccagcaacttcggcacccaaacccaaactactcacactaaatcgagcaccggtcgtgtatatactgtctgatggcgcgagggaggcgaatacg

SEQ ID NO: 791308 - DNA, 687 bp, Homo sapiens
  misc_feature: 27971.UNK.UNK.UNK.pb.heavy.1.raw 27971
tcagacagtatataggaagtagtccttgaccaggcagcccagggccgctgtgctctcggaggtgtcctggagcaggcgccagggaagaccgatggggcccttggtggaggctgaggagacggtgaccagggttccctggccccagtagtccaagcgggggaccgtctcgaggggctctcgcaccaataatagacagccgtgtcctcacttgtgaggttgtacatttgcagatgcagtgtggttcctggaatgtctctggagacggtgaatcggccccttcctcggagtctccgtagtgttcttcaattcccatcttctgatataattgccaccccactccagcccccttgcctggagcctggcggacccagtgcatggcataggtcctgaagatgaaatccagaggctgcacaggagaaagtctcagggagttcccaggctgggccgctcctcccccagactccactagctgcacctgacactggccacctcttaaaaagagcaacgaggaaaacccatctcagcccaaagtccatggtgagtcctctgtgttccagtgatgatcaccgaatggaaaacaccggcgacttccagtgctgggctcgtctcccccccctgagccgtagagctaaatcgaagccaccggtcgtgtatatactgtctgatgggcgcgagggaggcgatacg

SEQ ID NO: 791309 - DNA, 705 bp, Homo sapiens
  misc_feature: 27988.44.27.C05.1.pb.heavy.1.raw 27988
ctatgcgccttgccagcccgctcagacagtatataggaagtagttccttgaccaggcagccagggccgctgtgctctcggaaggtgcctcctggagcaggcgccaggggaagaccgatgggcccttggtggaggccgaggagacggtgaccagggttcccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagccccctcgcctggagcctggcggaccactgcatattcaattatcgaaggtgaatccagaggctgcacaggagagtctcagggacccccctactggggccacgcctccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccaggccccaaacccttcgatcgcgtctaaatcgagcaccggtcgtgtatatactgtctgatggcggcgagggaggcgatacg

SEQ ID NO: 791310 - DNA, 613 bp, Homo sapiens
  misc_feature: 28004.UNK.UNK.UNK.pb.heavy.1.raw 28004
cccgacacgcttgctaggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactggacgggatcgctacagacatttaactcgctagtaacttaattgagatcctaggggatgggataggaaatagaatccacccctatcaccccccacataggcctgcttgggtgttgagtttacttttatttcgtgttggaatgagttgaacttccgggaagtggagtaatgggtttgtctacttcccctaaccgcaaagtactagtttttacgagtggcgttgcaagcatagccagtccacaggtaataaaacaattcaacgtggcgtaaagattggccgcttgctgtgggcattgcaagctgggttttgcagcattgtgcatgctagacgaccaatatgaatctgcgggacccctagtggccaagatggccgctagcgggttccgcagctttttgacctggaccagggtgcatagcctgcccagccttcc

SEQ ID NO: 791311 - DNA, 607 bp, Homo sapiens
  misc_feature: 28026.UNK.UNK.UNK.pb.heavy.1.raw 28026
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgataggggtggattctatttcctatcccatccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 791312 - DNA, 717 bp, Homo sapiens
  misc_feature: 28073.UNK.UNK.UNK.pb.heavy.1.raw 28073
ctatgcgccttgccagcccgctcagacagtatataggaaagtagtccttgaccaggcagcccagggccgctgtgctctcggaggtgctcctggagcagggcgcagggggaagaccgatgggcccttggtggaggctgaagagacggtcaccactgtcccccggcccaagtactaaaggtgtcatgggggtcaccgtggtcctggctttcaaacagtaatagacgccctgtgtccctcgggtccaggtttttcatttggagaaacaatttgtcctgcgaattgtccctggaatggtgaagcgggcccttccacggagtctccgtagaaagtgacaccaccagctccgatacttgagacccactccagtcccctccctggagcccggcgacccaggtcatgccataggcactaaaggtgaatccagaggccgcacaggagagggtcagggacctcccaggccgaatcaggccccccccagactccaacaactgcacttcaacacacgacaccctttaaaaagccacaagaaaaaggcagctcagcccaaactccatggagacttcttctctgttcggtcctggtcaccaaatgaaagacacctgaaaatccccagggctgggctcctctctcagagctcccctttccccttatgcgactactaaatcgaagcaccggtccgtgtatatactgtctgatggcgcgagggaggcggatacg

SEQ ID NO: 791313 - DNA, 694 bp, Homo sapiens
  misc_feature: 28124.44.27.C05.1.pb.heavy.1.raw 28124
atcgcctccctcgcgccatcagacagtatatacacgaccggtgctcgatttagacgcgatcgaagggtttggggcctgggagacgagccccagcactggagtcgccggtgtttccactcggtgatcatcactgaacacagaggactcaccatggagtttgggctgagctgggtttttccttcgttgccctcttaagaggtgtcatgtgtcaggtgcaattcgtggagtctggggggaggcgtggccccagtagggggtcctgagactctcctgtgcagcctctggattcaccttcgataatggaatatggcagtgggtccgccagctccaggcgaggggctgagtggtgcaggtgtgtcatttcatggggaaatcaagtctacgggattccgttgagggagattcaccatctccagagacatccagtgtggccatttttacaaaatgaacagcctgagacctcacgacacaggcgtgctatttttggcaggcgatctatcgtttccaaattgtatttatatttggggccagggaacaatggtcaccgtctcttcgcttccaccaagggcccatcggtcttccccctggcgccctgcctccaggagcacctccggagagcacagcggccctgggctgcctggttcaaggactacttcctatatatactgtctgagcgggctggcaaggcgcatag

SEQ ID NO: 791314 - DNA, 707 bp, Homo sapiens
  misc_feature: 28126.UNK.UNK.UNK.pb.heavy.1.raw 28126
ctatgcgccttgcccagccgctcagacaggtatataggaagtagtccttgaccaggcagcccagggccgctgtgccccccagaggtgctcttggagggagggtgccagggggaagaccgatgggcccttggtggaggctgaggagacgggtgaccaggggttcccctggccccaggggtcgagccagttcgccccccccgtctctactgtatccgataggaatctctcgcacaataatatacggccgtgtccgcggcggtcacagaagtcaatttcagggagaacctggttcttggacctgtctagtgacatggtgactcgactcttgagggccgggggttgtagttggtgctgccggactggttatagatgcgccaatccactccagtcccttcccggcggactgccgcagccaactccaataatacctactgatgtaacccaccagaacattgcagggtgagggacagggtcttccgaaggcttcacccgtcctgggccccggactctgcagctgcacctcggaccacgaacccatctgggagggtgccaccaggaggaggaagaaccgcacaggtgtttcatgttcttgtgcaggaggcccatgagtctcagaaagtatccccaaacccaactatcgtggccgtaaatcgagcaccggtcgtgggtatatacctggcgtctgatggcgcgagggaggcgatacg

SEQ ID NO: 791315 - DNA, 696 bp, Homo sapiens
  misc_feature: 28170.44.73.G07.1.pb.heavy.1.raw 28170
ctatgcgccttgccagcccgctcagacagtatataggaagtagtccttgaccaggcagcccagggccgctgtgctctcggaggtgctcctggagcaggcgccaggggaagacgatggccttggtggaggctgaggagacgtgacagtgtcccctggcccagtgaaacgcccgataatagctgctggccacttcccgatctcgcacagtaatacagagcgagtcctcgcctctcaggctgatcatttccaggtacagagtgttccgggaattgtctctggagatggtgaatcggcccttcacggagtctgcataatatctagaagttccatcatatgctataactgccaaccactccggccccttgcctggagcctggcggacccagtgcatgccagaactactgaaactaaatccagaggcttcacaggagagtctcagggacctcccaggctggaccacgcctccccagacctccaccaggtgcacctgacactggacacctcttaaaagagtaacgaggaaaacccagctcagccaaactccatggtgagtcctctgtgttcagtgctgatcaccgaatggaaacaccgccgacttctagtgctgggctcctctccagagctcccctgagcgtagagctaaatcgagcaccggtcgtgtatatactgtctgatggcgccgagggaggcgatacg

SEQ ID NO: 791316 - DNA, 696 bp, Homo sapiens
  misc_feature: 28191.UNK.UNK.UNK.pb.heavy.1.raw 28191
cgtatcgcctccctcgcgccatcagtctatactatcacgaccggtgcctcgatttagacgcgatcgaagggtttggggcctggagacgagcccagcactggaagtcgccggtgtttccactcggtgatcatcactgaacacagaggactcaccatggagtttggctgagctgggttttcctcgttgccctcttaagaggtgtcatgtgtcaggtgcaattcgtggagtctggggaggcgtggccccagtagggggtccctgagactctcctgtgcagcctctggatcaccttcgataattggaatatgcagtgggtccgccaggctccaggcgaggggctggagtggtgcaggtgtgtcatttcatggaggaatcaagtctacggtgatttccgttgagggccgattcaccatctccagagacaattccgagaacacagtgtctcttcaatgaacgcctgagacctcaggacacggccgtgtatttttgtgcgagactatctgtttccaaaatcggttcattcgacgcctggggccagggaaccctggtcaccgtctcctcggcctccaccaaggcccatcggtcttccccctggcgccctgctccaggagcacctccgagagcacagcggccctgggctgcctggtcaaggactacttcctatatactgtctgagcgggctggcaaggcgcatag

SEQ ID NO: 791317 - DNA, 701 bp, Homo sapiens
  misc_feature: 28192.UNK.UNK.UNK.pb.heavy.1.raw 28192
ctatgcgccttgccagcccgctcagacagtatataggagtgtccttgacaggcgcccagggccgctgtgcccccagaggtgctctggaggagggtgccagggggaagaccgatgggcccttggtggaggctgaggagacggcgaccgtggtccctggccccaggcgtccatacattgagtaagcatgtcatactgtatccacggcccatctctccactagtttagacaggccgtgtcctcggcttcaggctttcattccagaataggtgtcttcgaatgttcctcctggagaggtgaatcggccttcacggaatcctacataatatttttacttccatcaccatataagtgccaccccccagttccctgcctggggcctggcggacccaggtgcatgccatggtcctgttgagggtgaatccaacgctacacaggagagtctcagggacctcccagggctggaccacgcctcccccaggactccaccagctcactgacactggacacctcttaaaaagcacgaggaaaacccaggtcagcccaactccatggtgagtcctcgtgttcgtgctgatcccgactggaaacaccgggacttctgggctgggctcctctcccagagctccccaacccaacgagctcaccctaaatcggagcaccggcgtgtatatactgtctgatggcgcgagggaggcgatacg

SEQ ID NO: 791318 - DNA, 664 bp, Homo sapiens
  misc_feature: 28196.UNK.UNK.UNK.pb.heavy.1.raw 28196
ctatgcgccttgccagcccgctcagacagtatataggaagtagtccttgaccaggcagcccagggccgctgtgctctcggaggtgctcctggagcagggcgccaggggaagaccgatgggcccttggtggaggccgaggagacggtgaccagggttccctggcccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaatgacacacctgccacccactccagcccctcgcctggagcctggcggacccactgcatattccaattatcgaaggtgaatccagaggctgcacaggagagtctcaggggacccccctactggggccacgcctcccccgactccacgaattgcacctgacacatgacacctcttagagggcaacgaggaaaacccagctcagcccaaactcgcatggtgagtcctctgtgttcagtgatgatcacgagtggaaacaccggcgacttccagtgctgggctcgtctcccaggccccaacccttcgatcgcgttctaaatcgagcaccggt

SEQ ID NO: 791319 - DNA, 659 bp, Homo sapiens
  misc_feature: 28309.44.86.H09.1.pb.heavy.1.raw 28309
cgtatcgcctccctcggcgccatcagacagtatatacacgaccggtgctcgatttagtgctatagacttgggtttggggatgcttttctgagagtcaaggacctcctgtgcaagaacatgaagcacctgtggtttttcctcctgctggtggcagctcccagatgggtcctgtcccaggtgcagctgcagagtcgggcccaggactggtgaggccttcgggaaaacctgtctctcatctgcactgtctctggagtttccatcagttctgatcattcttggggctggatccggcagcccccagggaggggaatggagtggatttggtgacatccattatactggggcgacgtactactctccgtccctcaagaagtcgtctcaccatttcgagggacacgtccatgaaccgcttctccctgaaactgacctccgtgaccgccgcggacacggccgtttatttctgtgcgaggcgagactggtctttcaaatctatggggccgtggcaccctggtcactgtctcctcagcttccacaagggcccatcggtcttccccctggcgccctgctccaggagcacctctggggcacagcggccctgggctgcctggtcaaggacttacttcctatatactgtctgagcgggctggcaaggcgcatag

SEQ ID NO: 791320 - DNA, 703 bp, Homo sapiens
  misc_feature: 28332.44.55.E11.1.pb.heavy.1.raw 28332
ctatgcgccttgccagcccgctcagacagtatataggaagtagtccttgaccaggcagcccagggccgctgtgccccagaggtggctcttggaggagggtgccagggggaagacgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgagggaggcgatacg

SEQ ID NO: 791321 - DNA, 651 bp, Homo sapiens
  misc_feature: 28347.44.86.H09.1.pb.heavy.1.raw 28347
cgtatcgcctccctcgcgccatcagacagtatatacacgaccggtgctcgatttagtgctatagacttgggtttgggatgctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctctggagtttccatcagttctgatcattcttggggctggatccggcagccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggccatcggtcttccccctggcgccctgctccaggagcacctctgggggcacagcggccctgggctgcctggtcaaggactacttcctatatactgtctgagcgggctggcaaggcgcatag

SEQ ID NO: 791322 - DNA, 700 bp, Homo sapiens
  misc_feature: 28397.44.27.C05.1.pb.heavy.1.raw 28397
cgtatcgcctccctcgcgcatcagacagtatatacacgaccggtgctcgatttagacgcgatcgaaggttttggggctgggagacgagcccagcactgaagtcgccggtgtttccactcggtgatcatcactgaacacagaggactcaccatggagtttgggctgagctgggttttcctcgttgccctcttaagaggtgtcatgtgtcaggtgcaattccgtggagtctggggaggcgtggccccagtaggggggtccctgagactctcctgtgcagcctctggattcaccttcgataattggaatatgcagtgggtccgccaggctccaggcgagggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 791323 - DNA, 669 bp, Homo sapiens
  misc_feature: 28402.UNK.UNK.UNK.pb.heavy.1.raw 28402
ctatgcgccttgccagcccgctcagacagtatataggaagtagtccttgaccaggcagcccagggccgctgtgcccagaggtgctcctggagcagggcgccaggggaagacgatggcccttgtggaagctgaggagacggtgaccagggttccctggcccaggggtcgaaccaattccatgtgtggactatgagaggactatgaagttgacgagggctctcgcacagaaatagatggccgtgtcttcagatctcagcctgctcagctcatgtaggctgtactcgtgattcgtcgcggtaatggtgactctgtcctgaaacttctgtgcgtaattcgatgcaccaaagatagggatgatccctccagcccactcagcccttgtccagggcctgtcgcacccaaataaaagcatagctgaagaaggtgcctcagaagccttgcaggagaccttcaccgaggacccaggcttcttcacctcagcccagactgcaccagctgcacctgggactggacacctgtagctgctgccaccacaaagaggaacgccaggtccagtccatggtgatgagctgtgctccagggcttctttagaggaggagtgtggttgttatgtgatcaaatcgagcaccggtcgtgtatactgtctgatggcgcgagggaggcgatacg

SEQ ID NO: 791324 - DNA, 679 bp, Homo sapiens
  misc_feature: 28412.44.12.B01.1.pb.heavy.1.raw 28412
cgcctccctcgcgccatcagacagtatatacacgaccggtgctcgatttagtagtgtagattccgcggggggctttctgagagtcaatggacctcctgtgcaagaacatgaagcacctgtggttcttcctcctgctggtggcggctcccagaatgggtcctgtccagctgcagctgcaggagtcgggccaggactggtgaagccttcggagaccctgtccctcacctcgcacgtctctggttctggtgcaggctccatcgcagtagtagttactactggggctggatccgcagcgcccccgcagggaaggggctgagtggatgggagtatctattatagtgggagcacctactacaaacccgtccctcaagagtcgagtcaccatatcagtagaccacgtccaagaaccagtttctcctgaagctgagctctgtggaccgccgcggacacggccgtgtattactgtgcgagagtagggcagttcgtcaccaactactttgaccactggggccagggaaaccctggtcaccgtctcctcagcctccaccaaggggcccatcggtcttccccctgggcaccctcctccaagagcacctctgggggcacagcggccctgggctgccctggtcaaggactactttcctatatactcgtctgagcgggctggcaaggcgcatag

SEQ ID NO: 791325 - DNA, 649 bp, Homo sapiens
  misc_feature: 28440.44.23.C01.1.pb.heavy.1.raw 28440
ctatgcgcccttgccagcccgctcagaacagtattaggaaagtagtccttgaccaagggccagcccagggccgctggtgccccagaggtgcgctcctggagcagggcgccagggggaagaccggatggggcccttggtggaagctgaggagacagtgaccagggtggccacggccccatagattgaaagaaccgagtctcgcctcgcacagaaataagacggccgtgtccgcgggcggcggtcacggaggtcagttttcagggagaagcggtttcatggacgtgtccctcgaaatggtgagacggactcttgagggacgggagggagtagtacgtcgccccagtataatggatgtcaccaatccactccattcccctccctgggggctgccggatccagccccaagaatgatcagaactgatggaaaactccagagacagtgcagatgagaagacagggttccgaaggcctcaccagtcctggcccgactcctgcagctgcacctggggaacaggacccatctgggagctgccaccagcaggaggaaaaaaccacaggtgtttcaccctgccccaatccctaatcacgtgtactaaatcgagcaccggtcgtgtatatactgtctgatggcgcgagggaggccgatacg

SEQ ID NO: 791326 - DNA, 677 bp, Homo sapiens
  misc_feature: 28490.44.36.D03.1.pb.heavy.1.raw 28490
agacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcaggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctggaattctggggctgggctccgctctcagagctcccaagagagatcgtgacgcagctaaatcgagcaccggtcgtgtatatactgtctgatggcgcgaggaggcgatacg

SEQ ID NO: 791327 - DNA, 708 bp, Homo sapiens
  misc_feature: 28492.44.9.A09.1.pb.heavy.1.raw 28492
ctatgcgccttgccagcccgctcagacagtatataggaagtagtccttgaccaggcagccagggccgctgtgctctcggaggtgctcctggagcagggcgccaggggggaagaccgatgggcccttggtggaggctgagagacggtgacccagggttccctggcccccagtagtcaagcgggaccgtctcgaggggctctcgcacaaataatagacagccgtgtcctcacttgtgagggttgtacatttgcagatgcgcgtgtgttcctggaattgtctctgggacggtgaatcggcgccctctctcggagtctccgtagtgttcttcaattccatcttctgatataattgccaccccactcagccccttgcctggaggcctggcggacccagtgcatggcataggtcctgaagatgaatccagaggctgcacaggagagtctcagggagttcccagggctgggccgctcctccccagactccactagctgcacctgacactggccacctcttaaagagcaacgaggaaaaacccatctcagcccaaagtccatggtgagtcctcctgtgtttcggagtgatgatcaccggaatggaaacaccggcgactccagtggctggctcgtctcccccccccctgcgcgtctcgctaaatcgagcaccggtcgtgtatatactgtctgaatggcgcgcgagggaggcgatacg

SEQ ID NO: 791328 - DNA, 697 bp, Homo sapiens
  misc_feature: 28495.44.33.C11.1.pb.heavy.1.raw 28495
ctatgcgccttgccgccgctcagacagtatataggaagtagtccttgacaggcagccaggccgctgtgcccccagaggtgcctggaggaggggccaggggaagacgatgggcccttggggaggctgaggagacggcgaccgtgtcctggccaggcgtcccattacatggagtagagcatgtcatatctgtatcccgagccccatctctcgcacgtagtagacagccgtgtcctcggctctcaggctattcattccagatagtgtttcttcgaattgtctctggagatgggaatcggcccttcacggaattctacataatatttattacttccatcataaccatataagtgccacccactccagtccttgcctggagcctggcgacccagtgcatgccatgtctgttgaggtgaatccagacgctacacaggagagtctcagggacctcccaggctggacccacgcctcccccagactccaccagctcacctgacactggacacctcttaaaaggcaacgaggaaaacccaggtcagcccaaactccatggtgagtcctctggttcggtgctgacaccgactggaacacgccgactctgtgctgggctcctctccagagctccccaaaccaacgagctcactctaaatcgagcaccggtcgtgtatatactgtctgatggcgcgaggagggcgatacg

SEQ ID NO: 791329 - DNA, 705 bp, Homo sapiens
  misc_feature: 28497.44.55.E11.1.pb.heavy.1.raw 28497
tatcgcctccctcgcgccatcagaccagtatataccacgaccggtgctcgatttagcactcgcacgttgggtttgggggggagaggagccagcactgggattcgaggtgtttccattcggtgatcagcactgaacacagaggactcaccatggagttttggctgagctgggttctccttgttggacttttaaaagggtcagtgtgaggtgcggctgatggagtctggaggagcttagtccagcctgggggtcccagagactctcctgtgcagcctctgggctcaccgtcagcagcaactacatgagttgggtccgccaggctccagggaaaggggctggagtgggtctcagtcatttatactggtgatttcacatactacgcagactccgtgaaggccgattcaccatctccagggacaattccaggaacacggttatcttcaaatgaacaacctgagaggcgacgacacggcgcgtgctattactgtgcgagacaagtcggcgctcggagtggttttattcgtttgacttctggggccagggaaccctggtcaccgtcgcctccgcctccaccaagggcccatcggtcttccccctggcaccctcctccaaagagcacctctgggggcacagcggccctggcggctgccctggtcaaggactacttcctatatacctgtctgagcgggctggcaaggcgcatag

SEQ ID NO: 791330 - DNA, 722 bp, Homo sapiens
  misc_feature: 28505.44.36.D03.1.pb.heavy.1.raw 28505
ctatgcgccttgccaggcccgccctcagacagtatatataggaagtagtccttgaccaggcagcccagggccgctgtgctctcggaggttgctcctggagcaggcgccagggggaagaccgatgggcccttggtggaggctgaggagaccgggtgaccagggttccctggccccagtggacaggttcctgatataaacacaacacaataatacatgcccgtgtcctcggttttcaggttagtcattcgcagaatcaatgagttcttgaagtcatctcttgagagggtgaaatctggcttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctccccccggactccaccaactggcccttcactctggacaccttgtaaaataaacacaaggaaaacccagctcagcccgaactccatggtgagtcctctgtgttcagtgctgatcaccaaatgaaaacacctgggaattctggggctgggggctccgctctcagagctccccaacgagagatcgtgacgcagctaaaatcgagcaccggtcgtgtagtaggttactgtctgatggcgcgagggaggcgatacg

SEQ ID NO: 791331 - DNA, 615 bp, Homo sapiens
  misc_feature: 28554.UNK.UNK.UNK.pb.heavy.1.raw 28554
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgccacagccaagcggccaatctttacgccacgttgaattgtttattacctgtgactgggctatggcttgcaacgccactcgtaaaaactagtactttgccggttaggggaagtagacaaacccattactccacttcccggaagttcaactcattccaacacgaaaataaaagtaaactcaacaccccaagcaggctatgtgggggggtgataggggtggattctatttcctatcccatcccctaggatctcaaattaagttactagcgagttaaatgtctgtagcgatcccgtcagtcctatcgcgcgcatcaagacctggttggttgagcgtgcagtagatcatcgataagctgcggaagttaggtcatcccagaccgcatctggcgcctaaacgttcagtggtagctaaaggcgtcaccttcgactgtctaaaggcaatatgtcgtccttagctcaagtccctagcaagcgtgtcggg

SEQ ID NO: 791332 - DNA, 668 bp, Homo sapiens
  misc_feature: 28575.UNK.UNK.UNK.pb.heavy.1.raw 28575
ctatgcgccttgccagcccgctcagacagtatataggaagtagtccttgaccaggcagcccagggccgctgtgctctcggaggtgctcctggagcagggcgccaggggagaccgatgggcccttggtggaggctgaggagacggtgaccagggttccctggcccgaatgaaaccatcccagacgtaatagacggctgtgtcctcggtgttcaggctgttcatctgcagagacaccgtatcttttgaatcatctcttgagatggtgaatctgcctttcacgggtgcagcgtagtctgctgtcccacgtcagctttggttctaatacggccaacccactccagccccttccctggagcctggcggaccagtcatccaggcgttactgaaagtgaatccagaggctgcacaggagagtctaagggactcccaggctttaccaaacctcccccagactccaccaactgcacctcacactggacaccttttaaatagcagcaaggaaaatccagctcagcccaaactccatggtgagtcctctgtgttcagtcctgatcactgaatgaaaacaccgggaatccaggctggggctctctccagagctcaacacactctctctaaatcgagcacggtcgtgtatatactgtctgatggcgcgaggaggcgatacg

SEQ ID NO: 791333 - DNA, 673 bp, Homo sapiens
  misc_feature: 28579.UNK.UNK.UNK.pb.heavy.1.raw 28579
ctatggcgcccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccagtggtcaaaagtagttggtgacgaactgccctactctcgcacagtaatacacggccgtgtccgcgcggtcacagagctcagcttcagggagaactggttcttggacgtgtctacgatatggtgactcgactcttgagggacgggttgtagtaggtgctcccactataatagatacttcccaatccactccagccccttccctggggggctggcggatccagccccagtagtaactactactgctgatggagccaccagagacagtgcaggtgagggacagggtctcgaaggcttcaccagtcctgggcccgactcctgcagctgcagctgggacaggacccatctggagccgccaccagcaggaggaagaaaccacaggtgcttcatgttctttgcacaggaagggtccatgactctccagaaagcccccgcggaatctacactactaaatcgagccaccggtcgtgtatatactggtctgatggcgcgagggaggcgatacg

SEQ ID NO: 791334 - DNA, 685 bp, Homo sapiens
  misc_feature: 28643.44.74.G08.1.pb.heavy.1.raw 28643
ctatgcgccttgccagcccgctcagacagtatataggaagtagtccttgaccaggcagcccagggccgctggccccagaggtgctcctggagcagggcgccagggggaagaccgatggcccttggtggaagctgaggtgacaatgaccagggttcctgcccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgcccggaagtctcgtgcgtaggtgagtgagccaaaaagagggatgattccaccatccactcaagcccttgtccagggcctggcgcacccagttgatggtataagtagtggaactggtagtacttcagaggccgtgcaggaaaggtcacgaggaccaaggttgcggcattctagtcccagactgcaccagttgcaccagggactggacacctgttgctgctgccaccacaaagaggaacctccaggtcccagtccatggtgatgagctgtgctcccagggcttctttagaggaggaatgtggttgttatgtgatgctccccctgatagagctactaaatcgagcaccggtcgtgtatatagctgtctgatggcgcgagggaggcgatacg

SEQ ID NO: 791335 - DNA, 620 bp, Homo sapiens
  misc_feature: 28644.UNK.UNK.UNK.pb.heavy.1.raw 28644
ctatgcgccttgccagccgctcagacagtatataggaagtagtccttgaccaggcagcccagggccgctgtgccccagaggtgctcctggagcagggcgccagggggaagaccgatgggccttggtggaagctgaggagacagtgaccagggtgccacggccccatagattgaaagaccagtctcgcctcgcacagaaataaaacggccgtgtccgcggcggtcacggaggtcagttttcagggagaagcggttcatggacgtgtcctcgaaatggtgagacgactcttgagggacggagagtagtacgtcgccccagtataatggatgtcaccaatccactccattcccctccctggggggctgccggatccagcccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgttcaccctgccccaatccctaatcacgtgtactaaatcgagcaccggtcgctgtatatactgtctgatggcgcgagggaggcgatacg

SEQ ID NO: 791336 - DNA, 700 bp, Homo sapiens
  misc_feature: 28705.UNK.UNK.UNK.pb.heavy.1.raw 28705
cgtatcgcctccctcgcgccatcagacagtatatacacgaccgtgctcgatttagagtatacatattggtttggggggagaggagcccagcactgggattccgaggtgtttccattcggtgatcagcactgaacacagaggactcaccatggagttttggctgagctgggttctccttgttgactttttaaaaggtgtccagtgtgaggtgcgctgatggagtctggaggaggctagtccagcctgggggtcccagagactctcctgtgcagcctctgggctcaccgtcagcagcaactacatgagttgggtccgccaggctccagggaaggggctgagtgggtctcagtcatttatactggtgatttcacatactacgcagactccgtgaaggccgattcaccatctccagggacaattccaggaacacggtttatcttcaatgaacaacctgagaggcgacgacacggccgtctattactgtgcgagacaagtcggcgctcggagtggttattattcgtttgacttctggggccagggaaccctgggtcaccgtcgcctccgcctccaccaaggggccatcggtcttccccctggcaccctcctccaagagcacctctggggcaccagcggccctgggctgcctggtcaaggactacttcctatatactgtctgatgccgggctggcaaggcgcatag

SEQ ID NO: 791337 - DNA, 1398 bp, Homo sapiens
  misc_feature: 28707.44.73.G07.1.pb.heavy.1.raw 28707
cgtatcgcctccctcgcgccatcagacagtatatacacgaccggtgctcgatttagctctacgctcaggggggagacgagcccagcactggaagtcgccggtgtttccattcggtgatcatcactgaacacagaggacctcaccatggactttgggctgagatgggttttcctcgttgctcttttaagaggtggccagtgtcaggtgcagctagtgagtctggggaggagcggccagcctggaactccctgagactctcctgtgcagcctctggattcatcttcaggacctatgccatgcactgggtccgccaggctccaggcaaggggctggagtgggtggcaattatatcagaagatggaattgaagaacatacggagactccgagaagggccgattcaccgtctccagagacaattccaggaacacactgcatctgcaaatgtacaacctcacaagtgaggacacggctgtctattattgtgcgagagccccctcgagacggtcccgcttgactactggggccagggaaccctggtcaccgtctcctcagcctccaccaaggcccatcggtcttcccccctgcgccctgctccaggagcacctccgagagcacagcggccctgggctgcctggtcaaggactacttcctatatactgtctgagcgggctggcaaggcgcatagcgtatcgcctcctcgcgccatcagacagtatatacacgaccgtgctcgatttagagtgagctcgttgggtttggggagctctgggagaggagccagcaccagaagtcggcggtgtttccagtcgtgatcagcaccgaacacagaggactcaccatggagtttgggctgacctgggttttcctcgttgctcttttaagaggtgtccagtgtcaggtgaagctggtggagtctggggagcgtggtccagcctgggaggtccctgaactctcctgtgtagcgtctggattcaccttcaacagacatggcatgcactgggtccgccaggctccaggcaagggactggagtgggtggcacttatatggtatgatgaagtaataaatattatgtagattccgtgaagggcgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaaggccatcggtcttccccctggcaccctcctccaagagcacctctggggcacagcggcctggctgcctgtcaaggactacttcctatatactgtctgagcgggctgcagggcatag

SEQ ID NO: 791338 - DNA, 613 bp, Homo sapiens
  misc_feature: 28759.UNK.UNK.UNK.pb.heavy.1.raw 28759
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctaagtaacttaattgagatcctaggggatggggataggaaatagaatccacccctatcaccccccacatagcctgcttggggtgttgagtttacttttatttcgtgttggaatgagttgaacttcccgggaagtggagtaatgggtttgtctacttcccctaaccgcaaagtactagttttacgagtggcgttgcaagccatagccagtcacaggtaataaacaattcaacgtggcgtaaagattggccgcttgctgtgggccattgcaagctgggtttggccagcattgtgcatgctagacgacaatatgaatctgcgggacccctagtggccaagatggccgctagcgggttccgcaggcttttgacctggaccaggcgtgcatagcctgcccagcct

SEQ ID NO: 791339 - DNA, 609 bp, Homo sapiens
  misc_feature: 28762.UNK.UNK.UNK.pb.heavy.1.raw 28762
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtggggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 791340 - DNA, 683 bp, Homo sapiens
  misc_feature: 28778.UNK.UNK.UNK.pb.heavy.1.raw 28778
cgtatcgcctccctcgcgccatcagacagttatatacacgaccggtgctcgatttaggtgagtcagtaagggaaaggggctgggagaggagcccagcactagaagtcggcggtgtttccattcggtgatcagcactgaacacagaggactcaccatggagtttgggctgagctgggtttttcctcgttgctctttaagaggtgtccagtgtcaggttcagctggtggagtctgggggaggcgtggtccgcctggacgtccctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttcccctggcgccctgctccaggagcacctccgagagcacagcggcccctgggctgcctggtcaaggactacttcctatatactgtctgagcgggctggcaaggcgcatag

SEQ ID NO: 791341 - DNA, 630 bp, Homo sapiens
  misc_feature: 28792.44.86.H09.1.pb.heavy.1.raw 28792
cgtatcgcctccctccgccatcagacagtatatacacgaccggtgctcgattagtgctatagacttgggtttggggatgctttcggagagtcaaggacctcctgtgcaagaacatgaagcactgtgtttttcctcctgctggtggcagctcccagaatgggtcctgtcccaggggcagctgcaggagtcggcccaggactggtgaggccttcgaccctgtctctcatctgcactgtctctggagttccatcagttctgatcattctgggggctggatccggcgccaggagggaatggattggtggtgacatccatgtatactggggcgacgaactactctccgtccctcaagagtcgtctcaccatttcgagggacacgtccatgaaccgcttctccctgaaactgacctccgtgaccgccgcgacacggcgtttatttctggtgcgaggcgagactggtctttcaatctatggggccgtggcacctgtcacttgttcctcagcttccaccaggccatgcggttcccccctggcgccctgctccaggagcactctggggcacagcggccctggctgcctggtcaaggactacttccgtatatactgtctgacgggctgcaaggcgcatag

SEQ ID NO: 791342 - DNA, 686 bp, Homo sapiens
  misc_feature: 28797.44.55.E11.1.pb.heavy.1.raw 28797
cgtatcgctcctcgcgccatcagacagtatatacacgaccggtgctcgatttagcactcgcacgttgggtttggggaagaggagcccagcactgggatccgaggtgtttccattcgtgatcagcactgacacagaggactccaccatggagttttggctgagctgggttctccttgttggacttttaaaaggtgtcccagtgtgaggtgcggctgatggagtctggaggaggcttagtccagcctgggggtccagagactctcctgtgcagccctgggctcaccgtcagcagcaactacatgagttgggttccgccagggctccagggaggggctggagtgggtctcagtcatttatactactggtgatttcacatactacgcagactccgtgaaggccgattcaccatctccagggacaattccaggaacacggtttatcttcaatgacaacctgagaggcgacgacacgccgtctatttactgtgcgagacagtcggcgctcggagtggttattattcgtttgactctggggcaggaccctggtcaccgtcgctccgcctccaccaggcccatcgtcttcccctggcaccctcctccaagagcacctctggggcacagcggcctggctgcctggtcaaggactacttcctatatactgtctgagcgggctggcaaggcgcatag

SEQ ID NO: 791343 - DNA, 672 bp, Homo sapiens
  misc_feature: 28801.UNK.UNK.UNK.pb.heavy.1.raw 28801
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccggggtcctttgccccagacgtccatgtagtagtaatacttgtattgttgtaacttctgcgaccctctggcacagtaataaagggcgtgtcgtccactcgcaggctcttcatctgcagaaacaccgtattcttggaattgtccctggagacgatgaagcggcccttcacggagtctgcggacatttgtggcactaccaccagtaatggatgagacccactccagccccttccctggggcctgacggacccagatcatggcataggtattaaggcgaatccagaggctgcacaggagagtgtcagggacccccccggctgtaccaagcctcccccgactccaacagctgcacttcacactggacacctttaaaacagccacaagaaaaagccagctcagcccaaaactccatggtgagttctctctgttcagtccccagggctgggctcctctctcttgcgacgacactaatcgagcaccggtcggtgtatatactgtctgatggcgcgagggaggcgatacg

SEQ ID NO: 791344 - DNA, 680 bp, Homo sapiens
  misc_feature: 28808.44.45.E01.1.pb.heavy.1.raw 28808
ctatgcgccttgccagcccgctcagacagtatataggaagtagtccttgaccaggcagcccagggccgctgtgctctcggaggtgctcctggagcagggcgccagggggaagaccgatggcccttggtggaggctgaggagacggtgaccagggctccctggccccagtagaacgatgggctcgtacaataatagagagcgagtcctcggctctcaaaattgttcatttgtagatacacgggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcagggacgtcccaggctgaccacgcctcccccagactccaccagctgaacctgacactggacacctctaaaagagcaacgaggaaaacccagctcagccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 791345 - DNA, 617 bp, Homo sapiens
  misc_feature: 28811.44.38.D05.1.pb.heavy.1.raw 28811
cgtatcgcctcctcgcgccatcagacagtatatacacgaccggtgctcgatttagtatctgatagctgggttttccttgttgctattttaaaaggtgtccagtgtgaggtgcagctgtggagtccgggggaggcttagttcagcctggggggtccctgagactctcctgtgcagcctctggattcaccttcagtagctactggatgcactggtccgccaagctccagggaagggggctggtgtgggtctcacgtattaatagtgatgggagtagcacaagctacggcgactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgccatag

SEQ ID NO: 791346 - DNA, 664 bp, Homo sapiens
  misc_feature: 28819.44.12.B01.1.pb.heavy.1.raw 28819
cgtatcgcctccctcgcgccatcagacagtatatacacgaccggtgctcgatttagtagtgtagattccgcgggggctttctgagagtcatggacctcctgtgcagacatgaagcacctgtggttcttcctcctgctggtggcggctcccagatgggtcctgttcccagctgcagctgccaggagtcgggcccaggactggtgaagccttcggagaccctgtccctcacctgcactgtctctgtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacgccgtgtattactgtgcgagagtagggcagttcgtcaccaactactttgaccactgggccagggaaccctggtcaccgtctcctcagcctccaccaagggcccatcggtcttccccccctggcaccctcctccaagagcacctctgggggcacagcggccctgggctgcctggtcaaggactacttcctatatactgtctgagcgggctggcaaggcgcatag

SEQ ID NO: 791347 - DNA, 673 bp, Homo sapiens
  misc_feature: 28826.UNK.UNK.UNK.pb.heavy.1.raw 28826
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggtgacaatgaccagggtttccctgcccccagatctcaaaggctccatgcgagctgggtacggacctctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaaagagggatgattccacccatccactcaagcccttgtccagggcctggcgcacccagttgatggtataagtagtggaactggtagtacttccagaggccgtgcaggaaagggtcaccgaggaccaaggttgcggcattctagtcccagactgcaccagttgcaccagggactggacacctgttgctgctgccaccacaaagaggaacctccaggtccagtccatggtgatgagctgtgctcccaggggcttctttagaggaggaatgtggttgtcagtagatctaaatcgagcaccgtcgtgtatatactgtctgatggcgcgagggaggcgatacg

SEQ ID NO: 791348 - DNA, 705 bp, Homo sapiens
  misc_feature: 28831.UNK.UNK.UNK.pb.heavy.1.raw 28831
ctatggcgccttgccagcccgctcagacagtatataggaagtagtccttgaccaggcagcccgagggccgctgtgctctcggaggtgctcctgagcagggcgccagggggaagaccgatgggcccttggtggaggctgaggagacggtgaccagggttcctggcccagtggacagttcctgatataaacacaacacaataatacatgcccgtgtcctcggtttcaggttagtcattcgcagaaatcaatgagttcttgaagtcatctcttgagagggtgaatctggctttcacagacgcggcgtactctgtgataaagctggcaacttgtttttactcgccaagccactccagcccctttcctggagcctggcggacccagtccatatagtggtcactggatggtgaatccagaggcgacacaggagagtctcaagggaccctccaggctggaaccaagtcccccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatggagcaccggtcgtgtatatactgtctgatggcgcgatgggaggcgatacg

SEQ ID NO: 791349 - DNA, 686 bp, Homo sapiens
  misc_feature: 28841.44.27.C05.1.pb.heavy.1.raw 28841
cgtatcgcctccctcgcgccacgaccggtgctcgatttagacgcgatcgaagggtttgggagccctgggagacgagcccagcactggaagtcgccggtgtttccactcggtgatcatcactgaacacagaggactcaccatggagtttgggctgagctgggtttcctcgttgccctctaagaggtgtcatgtgtcaggtgcaattcgtggagtctgggggaggcgtggccccagtagggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggccatcggtcttccccctggcgccctgctcaggagcacctccgagagcacagcggccctgggctgcctggtcaaggactacttcctatatactgtctgagcgggctggcaaggcgcatag

SEQ ID NO: 791350 - DNA, 787 bp, Homo sapiens
  misc_feature: 28940.44.27.C05.1.pb.heavy.1.raw 28940
ctcttatgccgcctagcttggccagcgctcgtcgctcaggcagtagtgaggagggaagtgtcctttgaccaggcagaccccagggccgctgtgctctcggaggtgctcctggagcaggtgcgccaggcggaaagaccgatggggccctttggtggaggccgaggagaacggtgaccaggcgcgttccctggccccaggcgtcgaatgaacccgatttggaaacagatagtctcgcacacaacaatcactggggaggccgtgcggtccccggccgtgtcctgaggccagggctgttcatttgaagagacaccatcctgtgttaaaactggcgaattgtctctggagatggtgaatcgccttcctcaacggaatcaccgtagacttgatttcctcattgaaatgacacacccttgccacccactgaaatgaccatgcacccactcagccccctcgcctggagcctggcggaccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccagaactccatggtgagtcctctgtgttcagtgatgatcaccgagtggaaacaccgggcgacttccagtgctgggctcgtctcccagccccaaacccttcgatcgcgtctaaatcgagcaccggtcgtgtatatactgtctgatggcgcgaggaggcgatacg

SEQ ID NO: 791351 - DNA, 694 bp, Homo sapiens
  misc_feature: 28965.44.73.G07.1.pb.heavy.1.raw 28965
cgtatcgcctcctcgcgccatcagacagtatatacacgaccggtgctcgatttagctctacgctcaggggagctctgggagaggagcccagcactagaagtcggcggtgtttccattcggtgatcagcactgaacacagaggactcaccatggagttgggctgagctgggttttcctcgttactctttaagaggtgtcagtgtcaggtgcacctggtggagtctgggggaggcgtggtccagcctgggaggtccctgagactctcctgtgaagcctctgatttagttcagtagttctggcatgcactggtccgccaggctccaggcaagggccggagtggttggcagttatagcatatgatggaacttctagatattatgcagactccgtgaagggccgatcaccatctccagagacaatcccggaacactctgtacctggaaatgatcagcctgagaggcgaggactcggctctgtattactgtgcgagatcgggaagtggcagcagctattatcgggcgtttcactggggccaggggacactggtcaccgtctcctcagcctccaccaagggcccatcggtcttccccctggcgccctgctccaggagcacctccgagagcacagcggcctgggctgcctggtcaaggacacttcctatatactgttctgagcgggctggcaaggcgcatag

SEQ ID NO: 791352 - DNA, 684 bp, Homo sapiens
  misc_feature: 29017.44.45.E01.1.pb.heavy.1.raw 29017
ctatgcgccttgccagcccgctcagacagtatataggaagtagtccttgaccaggcagcccagggccgctgtgctctcggaaggtgctcctggagcagggcgccaggggaagaccgatgggccttgtggaggctgaggaggacggtgaccagggctccctggccccgtagaacgatggggctcgtacaataatagagagccgagtcctcggctctcaaattgttcatttgtagatacacggtgttctggaattgtctctggagacggagaatactcgcccttcacggagtttccatagtattctttacttccatcagaccagatgatgcaccacactccagccccttgcctggagcctggcgacccagtgcatggcagagtcactgaaactgagtccggacgcaacacagagagtctcagggacggtcccagggctggaccacgcctccccagactccaccagctgaacctgacactggacacctcttaaaagagcaaacgaggaaaaaccagctcagcccaaactccatggtgagtcctctgtgttagtgctgatcaccgaatggaaacaccgccggacttctagtgctgggctcctctcccagcccccttttcccttactgactcactaaatcgagcaccggtcgtgtatatactgtctgatggcgcgagggaggcgatacg

SEQ ID NO: 791353 - DNA, 695 bp, Homo sapiens
  misc_feature: 29076.UNK.UNK.UNK.pb.heavy.1.raw 29076
cgtatcgcctccctcgcgccatcagacagtatatacacgaccgtgctcgatttagacgcgattcgaaggtttggggcctggagacgagccagcactggaagtcgccggtgttccactcggtgatcatcactgaacacagaggatcaccatggagtttgggctgagctgggttttcctcgttgccctctaagaggtgtcatgtgtcaggtgcattcgtggaggtctgggggaggcgtggccccagtaggggggtccctgagactctcctgtgcagcctctggattcaccttcgataattggaatatgcagtggtccgccaggctccaggcgagggctggagtgggtggcaggtgtgtcatttcatggaggaaatcaagtctacggtgattccgttgagggccgattcaccatctccagagacaatccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcggctggcaaggcgcatag

SEQ ID NO: 791354 - DNA, 689 bp, Homo sapiens
  misc_feature: 29087.44.36.D03.1.pb.heavy.1.raw 29087
cgtatcgcctcctcgcgccatcagacagtatatacacgaccggtgctcgatttagctgcgtcacgatctctctggagctctcagagaggtgccttagccctggattccaaggcatttccactggtgatcagcactgaacacagaggactcaccatggagttggggctgcgcgctggttttccttgttgctattttagaaggtgtccactgtgaggtgcggctgtggagtctggggagctggtacagcgggggggtcctgagactctcctgtgcagcctctggattcatcttcagtgactatgccatgaactggtccgccaggctccagggaaggggctggagtgggtttcatatgtaatattgctggagataccacctactacgcagactctgtgaagggccgattcaccattccagggacaatgcaagaactcactgtatctggaaatgaacagcctgagagacgagacacggctgtctacttctgttcgagagatcgggccacttggtcagtggctggtttgactactggggccggggaccctggtcaccgtctcctcagcctccaccaaggccatcggtcttccccctggcgccctgctccaggagcacctccgagagcacagcggccctggctgcctggtcaaggactacttcctatatactgtctgagcgggctggcaaggcgc

SEQ ID NO: 791355 - DNA, 680 bp, Homo sapiens
  misc_feature: 29100.44.45.E01.1.pb.heavy.1.raw 29100
ctatgcgccttgccagcccgctcagacagtatataggaagtagtccttgaccaggcagccagggccgctgtgctctcggaggtgctcctggagcagggcgccaggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcagggacgtcccaggctggaccacgcctccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 791356 - DNA, 708 bp, Homo sapiens
  misc_feature: 29103.UNK.UNK.UNK.pb.heavy.1.raw 29103
ctatgcgccttgccagccgctcagacagtatatagcgaagtagtccttgaccaggcagcccagggccgctgtgctccggaggtgctcctggagcagggcgccaggggaagaccgatggggcccttggtggaggctgaagagacggtcaccactgtcccccggccccaagtactaaaggtgtcatggggggtcaccgtgtcctggcttcaaacagtaatagacgcctgtgtcctcgggtctcaggtttttcatttggagaaacaatttgtcctgcgaattgtccctggaaatggtgaagcggcccttcacggggagtctccgtagaaagtgacaccaccagctccgatacttgagacccactcagtcccctccctggaggccggcggacccaggtcatgccataggcactaaaggtgaatccagaggccgcacaggagagggtcagggacctcccaggccgatcaggcccccccccagactccaacaactgcacttcacacacgacaccctttaaaaaagccacaagaaaaggcagcttcagcccaaactccatggagacttctctctgttcggtcctggtcaccaaatgaagacacctgaaatcccagggctgggctcctctctcagagctcccctttccctttatgcgactactaaatcgagcaccgtcgtgtatatactgtctgatggcgcgagggaggcgatacg

SEQ ID NO: 791357 - DNA, 682 bp, Homo sapiens
  misc_feature: 29114.44.35.D02.1.pb.heavy.1.raw 29114
cgtatcgcctccctcgcgccatcagacagtatataccacgaccggtgctcgatttagcacacgatagttgcgggtttgggatactttctggagactcatgggcctcctgcacaagaacatgaaacacctgtggttcttcctcctcctggtggcacctcccagatggggtcgtgtcgaggtgcagctgcaggagtcggcgcccaggacggggtgaagccttcggagaccctgtccttcacctgcatgtctctggtggttacatcagtagttattattggagttggctgccggcagtccgccgggaagggactggagtggattggcgcatctataacagtgcagcaccaatacaacccgcgccctcaagagtcgagtcacccatgtcactagacaggtccaagaaccagttctccctgaaattgacttctgtgaccgccgcggacacgccgtatattattgtgcgagagattcctatcgatacagtagagacggggggccgaactggctcgacccctggggccagggaaccctggtcaccgtctcctcagcctccaccaagggcccatcggtcttccccctggcaccctcctccaagagcacctctgggggcacagcggcctgggctgcctggtcaaggaactacttcctatatactgtctgagcgggctggcaaggcgcatag

SEQ ID NO: 791358 - DNA, 705 bp, Homo sapiens
  misc_feature: 29132.44.36.D03.1.pb.heavy.1.raw 29132
cgtatcgccctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctgggcaaggcgcatag

SEQ ID NO: 791359 - DNA, 686 bp, Homo sapiens
  misc_feature: 29136.44.73.G07.1.pb.heavy.1.raw 29136
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagtgtcccctggccccagtgaaacgcccgataatagctgctgccacttcccgatctcgcacagtaatacagagccgagtcctcgcctctcaggctgatcatttccaggtacagagtgttccgggaattgtctctggagatggtgaatcggcccttcacggagtctgcataatatctagaagttccatcatatgctataactgccaaccactccggccccttgcctggagcctggcggacccagtgcatgccagaactactgaaactaaatccagaggcttcacaggagagtctcagggacctccaggctggaccacgcctcccccagactccaccaggtgcacctgacactggacacctcttaaaagagtaacgaggaaaacccagctcagcccaaactccatggtgagtcctctgtgttcagtgctgatcaccgaatggaaaacaccgccgagagcacagcggccctgagcgtagagctaaatcgagcaccggtcgtgtatatactgtctgatggcgcgaggggaggcgatacg

SEQ ID NO: 791360 - DNA, 706 bp, Homo sapiens
  misc_feature: 29155.44.36.D03.1.pb.heavy.1.raw 29155
ctatgcgccttgccagcccgctcagacagtatataggaagtagtccttgaccaggcagcccagggccgctgtgctctcggaggtgctcctggagcagggcgccaggggaagaccgatgggccctggtggaggctgaggagacggtgaccagggttcccccggccccagtagtcaaaaccagccactgaccaagtggcccgatctctcgaacagaagtagacagccgtgtcctcgtctctcaggctgttcatttccagatacagtgagttcttggcattgtccctggaattggtgaatcggcccttcacagagtctgcgtagtaggtggtatctccagcatattaacatatgaaaccactccagccccttccctggagcctggcggacccagttcatggcatagtcactgaagatgaatccagaggctgcacaggagagtctcaggacccccccgctgtaccaagcctcccccagactccaccagccgcacctcacagtggacaccttctaaaatagcaacaaggaaaaccagcgcagccccaactccatggtgagtcctctgtgttcattgctgatcaccaagtggaaatgccttggaatccagggctaaggcacctctctgagagctcccaagagagatcgtgacgcagctaaatcgagcaccggtcgtgtatatactgtctgatggcgcgagggaggcgatacg

SEQ ID NO: 791361 - DNA, 712 bp, Homo sapiens
  misc_feature: 29215.44.36.D03.1.pb.heavy.1.raw 29215
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccccggcccccagtagtcaaaaccagccactgaccaagtggcccgatctctcgaacagaagtagacagccgtgtcctcgtctctcaggctgttcatttccagatacagtgagttcttggcattgtccctggaattggtgaatcggcccttcacagagtctgcgtagtaggtggtatctccagcaatattaacatatgaaacccactccagccccttccctggagcctggcggacccagttcatggcatagtcactgaagatgaatccagaggctgcacaggagagtctcagggaccccccccgctgtaccaagcctcccccagactccaccagccgcacctcacagtggacaccttctaaaatagcaacaaggaaaaccagcgcagccccaactccatggtgagtcctctgtgttcagtgctgatcaccaagtggaaatgccttggaatccagggctaaggcacctctctgagagctcccaagagagatcgtgacgcagctaaatcgagcaccggtcgtgtatatactgtctgatggcgcgagggaggcgatacg

SEQ ID NO: 791362 - DNA, 707 bp, Homo sapiens
  misc_feature: 29258.44.36.D03.1.pb.heavy.1.raw 29258
ctagcgccttggccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccggtgtcctcggttttcaggttagtcattcgcagaatcaatgagttcttgaagtcatctcttgagagggtgaatctggctttcacagacgcggcgtactctgtgataaagctggcaactttgttttactggcggccaagccactccagcccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaaatccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 791363 - DNA, 692 bp, Homo sapiens
  misc_feature: 29285.44.70.G04.1.pb.heavy.1.raw 29285
cgtatcgcctcctcgcgccatcagacagtatatacacgaccggtgctcgatttagtgtagtgtgaagggaaagggtctgggagaggagccagcactagaagtcggcggtgtttccattcggtgatcagcactgaacacagaggactcaccatggagtttgggctgagctggttttcctcgttgctcttttaagaggtgtccactgtcaggtgcacctggtggagtctggggaggcgtgtcagcctgggaggtcctgagactctcctgtgaagcctctggatttagtttcagtggttctggcatgcactgggtccgcaggctccaggcaagggccggagtggttggcagttatagcacatgatggaagttctgaatattatgcagactccgtgaagggccgattcaccatctccagagacaattccggaacattgtgtacttggaaatggtcagcctgagagtcgaggactcggctctgtattactgtgcgagatcggaggtgtagtagttattaccgggcgcatgactgggccagggaccctggtcaccgtctcctcagcctccaccaagggcccatcggtcttccccctggcgccctgctccaggagcacctccgagagcacagcggccctgggctgcctggtcaaggactacttcctatatactgtctgagcggctggcaaggcgcatag

SEQ ID NO: 791364 - DNA, 691 bp, Homo sapiens
  misc_feature: 29287.UNK.UNK.UNK.pb.heavy.1.raw 29287
cgtatcgcctcctcgcgccatcagacagtactatacacgacggtgctcgatttagtagtcgcataaagggaaaggggagctctgagagaggagcccagccctggattttcaggtgtcttcattggtgaccaggaccgaacagagagaagtctccatggagtttgggctgagctgcctttttcttgtggcttttttaaagggtgtcgtgtgtgaagtgcagttgttggagtctgggggggcctgatcgcctggaggtccctgaccctctcctgtgcggctctggattcacctttagtgcctatggcatgacctgggtccgccggctccagggaggggactggagtggtctcaagtatcggagctggtggtgtcactttctacggagactccgtgaagggccgcttcaccatttccagggacaatcgcaggacaaattgtttctcaaatgaaaaacctgagaccgaggacacaggcgtctattactgtttgaaagccaggaccacggtgacccccatgacacctttagtacttgggccggggacagtggtgaccgtctcttcagcctccacaagggccatcggtcttcccctggcgccctgctccaggagcacctccgagagcacagcggccctggctgcctggtcaagactacttcctatatactgtctgagcgggctggcaaggcgcatag

SEQ ID NO: 791365 - DNA, 664 bp, Homo sapiens
  misc_feature: 29329.UNK.UNK.UNK.pb.heavy.1.raw 29329
ctatgcgccttgccagcccgctcagacagtatataggaagttagtcttgaccaggcagccagggccgctgtgcccccagaggtgcttcctggagcagggcgccagggggaagaccgatgggcccttggtggaagcctgaggtgacaatgaccagggttcctgcccccagatctcaaaggctccatgcgagctggggtacggacctctcgcacagtagtagacggcgtgtcgtcggatttcaaagaactcattgtcatggagactgtgtctgtgacttgtccgcggtaatcgtattctgcccgaagtctcgtgcgtaggtgagtgagccaaaagagggatgattccacccatccactcaagcctttgtccagggcctggcgcacccagtgatggtataagtagtggaactggtagtacttccagaggccgtgcaggaaagggtcaccgaggaccaaggttgcggcattctagtcccagactgcaccagttgcaccagggactggacacctgttgctgctgccaccacaagaggacctccaggtccagtccatggtgatgagctgtgctcccagggcttcttttagaggaggaatgtggttgtcagtagatctaaatcgagcaccgtcgtgtatatactgtctgatggcgccgaggaggcgatacg

SEQ ID NO: 791366 - DNA, 705 bp, Homo sapiens
  misc_feature: 29341.UNK.UNK.UNK.pb.heavy.1.raw 29341
ctatgcgccttgccagccgctcagacagtatataggaagtagttccttgaccaggcagcccagggccgctgtgctctcggaggtgctcctggagcagggcgccagggggaagaccgatgggcccttgtggaggctgaggagaacggtgaccagggttccctggccccagtggacagttcctgatataacacaacacaataatacaatgcccgtgtcctcggttttcaggttaggtcattcgcagaatcaatgagttcttgaagcatcctcttgagagggtgaatctggcctttcacagacgcggcgtactctgtgataaagctggcaactttgttttttactgcggcaagccactccagcccttccctggagcctggcggaccagtccattatagtggtccactgatggtgaatccagaggcgacacaggagagtctcagggaccctccaggctggaccaagtctcccccggactccaccaactgcacttcactctggacaccttgtaaaataacaacaaggaaaacccagctcagcccgaactcccatggtgagtcctctgtgttcagtgctgatcaccaaatgaaaacacctggaattctggggctggggctccgctctcagagctccccaagagagatcgtgacgcagctaaatcagcaccgtcgtgtatatactgtcttgatggcgcgaggaggcgatacg

SEQ ID NO: 791367 - DNA, 653 bp, Homo sapiens
  misc_feature: 29345.44.23.C01.1.pb.heavy.1.raw 29345
ctatgcgccttgccagcccgctcagacagtatataggaagtagtccttgaccaggccagcccagggccgctgtgcccccagaggtgctcctggagcagggcgccagggggaagaccgatgggcccttggtggaagctgaggagacagtgaccagggtgccacggccccatagattgaaagaccagtctcgcctagcacagaaataaacggccgtgtccgcggcggtcacggaggtcatttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggtcccgaaggcctcaccagtcctgggcccgactcctgccagctgcacctgggacaggacccatctgggagctgccaccagcaggaggaaaaaccacaggtgcttcatgttcttgcacaggaggtccttgactctcagaaagcccccaatccctaatcacgtgtactaaatcgagcaccggtcgtgtatatactgtctgatggcgcgagggaggcgatacg

SEQ ID NO: 791368 - DNA, 619 bp, Homo sapiens
  misc_feature: 29352.44.38.D05.1.pb.heavy.1.raw 29352
cgtatcgcctccctcgcgccatcagacagtatatacacgaccggtgctcgatttagtatctgatagctgggttttccttgttgctattttaaaaggtgtccagtgtgaggtgcagctggtggagtccggggagcttagttcagcctgggggggtccctgagactctcctgtgcagcctctggattcaccttcagtagctactggatgcactgggtccgccaagctccagggaaggggctggtgtgggtctcacgtattaatagtgatgggagtagcacaagctacgccggactccgtgaaggggccgattcaccatctccagagacaacgccaaagaacacgctgtatctgcaaatgaacagtctgagagccgagacacggctgtgtattactgtgcaagagccggtgcgggagttcggggagttgcatactactactacggtatggacgtctggggcccaagggaccacggtcaccgtctcctcagcttccaccaaggcccatcggtcttccccctggcgccctgctccaggagcacctctgggggcacagcggcctgggctgcctggtcaaggactacttcctatatactgtctgagcgggctggcaaggcgcatag

SEQ ID NO: 791369 - DNA, 563 bp, Homo sapiens
  misc_feature: 29405.44.78.H01.1.pb.heavy.1.raw 29405
ctatgcgccttgccagcccgctcagacagtatataggaagtagtcttgaccagggcagcccagggccgctgtggctctcggaggtgctcctggagcaggcgccaggggaagaccgatggcccttggtggaggctgaggagacggtgaccagggttccctggcccacaaggtcaagccaggtgctggtggctctcgcacagaaatacacggccgtgtctcagatctcaggctgctcagttgcatgtagactgtacctggggaggtgctcctggtcatactaactctgccttggaacttctgggcaaagccgttgccactatagggcttcatccatccatccactccagcccttgtccagcggcctgtcgcaccagttaatatcataattgatgaacgtgtatccagaagccgtgcaggagactgtcactgaggccccaggcttcttcacctcagcaggcgtggtgaccgtgacctccagcaacttcggcaccaaacccaaactactcacactaaatcgagcaccggtcgtgtatatactgtctgatgcgcgaggaggcgatacg

SEQ ID NO: 791370 - DNA, 672 bp, Homo sapiens
  misc_feature: 29430.44.12.B01.1.pb.heavy.1.raw 29430
cgtatcgcctccctcgcgccatcagacagtatatacacgaccggtgctcgatttagtagtgtagattccgcggggctttctgagagtcatggacctcctgtgcaagaacatgaagcacctgtggttcttcctcctggctggtggcggctcccagatgggtcctgtcccagctgcagctgcaggagtcggcccaggactggtgaagccttcggagaccctgtccctcacctgcactgtctctggtggctccatcagcagtagtatagttactactgggggctggatccgccagcccccagggaaggggctggagtggattggagtatctattatagtgggaggcacctactacaacccgtccctcaaggagtcgagtcaccatatcagtagaacacgtccaagaacccagttctcccctgaagctgagctctgtgaccgccgcggacacggccgtgtatttactgtgcgagagtagggcagttcgtcaccaactacttgaccactggggccagggaaccctggtcaccgtctcctcagcctccaccaagggcccatcggtcttccccctggcaccctcctccaagagcacctctggggcacagcggccctgggctgcctggtcaagggactactttcctatatactgtctgagcgggctggcaaggcgcatag

SEQ ID NO: 791371 - DNA, 572 bp, Homo sapiens
  misc_feature: 29437.44.78.H01.1.pb.heavy.1.raw 29437
cgtatcgcctccctcgcgccatcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggaaggcgcatag

SEQ ID NO: 791372 - DNA, 701 bp, Homo sapiens
  misc_feature: 29440.44.55.E11.1.pb.heavy.1.raw 29440
cgtatcgcctccctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 791373 - DNA, 727 bp, Homo sapiens
  misc_feature: 29455.UNK.UNK.UNK.pb.heavy.1.raw 29455
cgtatcgcctcccttcgcgccatcagacagtatatacacgaccgggtgctcgatttagctgcgtcacgatctctcttgggggagctctgagagcggagcccccagccccagaattccaggtgttttcattttggctgatcaggcactgaacacagaggactcaccatggagttcgggctgagctggggtttttcctttgttgttattttacaaggtgtccagagtgaagtgcagttggtggagtccggggggacttggtccagcctggagggtccctgagactctcctgtgtcggcctctggattgcaccatcagtgaccactatatggcacctggtgcgtcgccaggcctccagggaaggggctggagtggcttggccgcagtaaaacaaagttgcgcagctttatcacagagtacgccgcgtctgtgaaagccagattcacacctctcaagagatgacttcaagaaactcattgattctgcgaatgactaacctgaaaaccgagggacacgggcatgtattattgtgttgtgtttatatcaggaactgtccactggggccagggaaccctggtcaccgtctcctcagccttccacccaagggcccatcgtcttccccctgggcgccctgctccaggagcacctccgagagcacagcggccctgcggctggcctggtcaaggactacttcctatatactgtctgagcgggctggcaaggcgcatag

SEQ ID NO: 791374 - DNA, 703 bp, Homo sapiens
  misc_feature: 29469.44.27.C05.1.pb.heavy.1.raw 29469
ctatgcgccttgccagcccgctcagacagtatataggaagtagtccttgaccaggcagcccagggccgctgtgctctcggaggtgctcctggagcagggcgccaggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggcctcaacggaatcaccgtagacttgatttcctccatgaaatgacacacctgccacccactccagccctcgcctggagcctggcggacccactgcatattccaattatcgaaggtgaatccagaggctgcacaggagagtctcagggacccccctactggggccacgcctccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagggctccccaaacccttcgatcgcgtctaatcgagcaccggtcgtgtatatactgtctgatggcgcgagggaggcgatacg

SEQ ID NO: 791375 - DNA, 723 bp, Homo sapiens
  misc_feature: 29471.44.86.H09.1.pb.heavy.1.raw 29471
ctatgcgccttgccagcccgctcagacagtatataggaagtagtccttgaccaggcagcccaggccgctgtgcccccagaggtgctcttggaggagggtgccaggggaagaccgatgggccttggtggaggctgaggagacggcgaccgtggtcccttggccccaggcgtccataccattgagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccacacctccagtcccttgcctggagcctggcggacccagtgcatgccatgtctgttgaaggtgaatccagacgctacacaggagagtctcaggacctcccaggctggaccacgcctccccagactccaccagcttcacctgacactggacacctcttaaaagagcaacgaggaaaacccaggtcagcccaaactccatggtgagtcctctgtgttcggtgctgatcaccgactgaaacaccgccgacttctggtgctggctcctctccagagctccccaacccaagtctatagcactaaatcgagcaccggtcgtgtatatactgtctgatggcgcgagggaggcgatacg

SEQ ID NO: 791376 - DNA, 706 bp, Homo sapiens
  misc_feature: 29490.44.27.C05.1.pb.heavy.1.raw 29490
ctatgcgccttgccagcccgctcagacagtatataggaagtagtccttgaccaggcagcccaggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatatccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagggctccccaaacccttcgatcgcgtctaaatcgagcaccggtcgtgtatatactgtctgatggcgcgagggaggcgatacg

SEQ ID NO: 791377 - DNA, 696 bp, Homo sapiens
  misc_feature: 29501.44.74.G08.1.pb.heavy.1.raw 29501
ctatgcgccttgccagcccgctcagacagtatataggaagtagtccttgaccaggccagcccagggccgctgtgcccccagaggtgctcctggagcagggcgccagggggaagaccgatgggcccttggtggaagctgaggtgacaatgaccagggttccctgccccagatctcaaaaggctccatgcgagctggggtacggacctctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaaagagggatgattccacccatccactcaagcccttgtccaggggcctggcgcacccagttgatggtataagtagtggaactggtagtacttccagaggccgtgcaggaaagggtcaccgaggaccaaaggttgcggcattctagtcccagactgcaccagttgcaccagggactggacacctgttgctgctgccaccacaaagaggaacctccaggtccagtccatggtgatgagctgtgctcccaggggcttctttagaggaggaatgtggttgttatgtgatgctccccctgatagagctactaaatcgagcaccggtcgtgtatatactgtctgatggcgcgagggaggcgatacg

SEQ ID NO: 791378 - DNA, 668 bp, Homo sapiens
  misc_feature: 29503.UNK.UNK.UNK.pb.heavy.1.raw 29503
ctatgcgccttgccagcccgctcagacagtatataggaaagtagtccttgaccaggcagcccagggccgctgtgctctcggaggtgctccctggagcagggcgccagggggaagaccgatgggcccttggtggaggctgaatgagacggtgacctggattccctggccccagggttcgaagaagcccgtggtcatttgtggtcatgaagtgggcacagaaatatgtgcctgtgtccacagggtccacgttggtcaatgtaaggaccacctggtttttggacgtgtcctttcgtgagcgtggagtctggtccgtcagagaaggactatatcgtatatcgtcattccaataagtgagtgcgatcccactccaggggcctttccgggggggctgccgcacccagacaacgccctctccaggagtgacgagtgagaagcctgagacggtgcaggtcagcgtgagggtctgtgtgggttttcaccaatgtagggccagactctttcacgggtgatctgggacaggccccatgaagggatggtcagcagcagggagcgtggagcaaagtgtgtccatggtggggcacaaggagtccccctttcccttcacactacactaaatcggagcaccggtcgtgtatatactgtctgatggcgccgagggaggcgatacg

SEQ ID NO: 791379 - DNA, 648 bp, Homo sapiens
  misc_feature: 29518.UNK.UNK.UNK.pb.heavy.1.raw 29518
ctatgcgccttgccagcccgctcagacagtattaggaaagtatcccctgagccaggcagccagggccgctgtgccccagaggtgctcctggcgcagggcgccagggggaagcacgatgggcccttggtggagctgaggagacagtgaccaggccaggcccgcgcccatagattgaaagaccagtctcgcctcgcacagaataaacggcgctgtgccggcgggtcacggaggtcagttcagggagaaggcggttcatggacgtgtccctcgaaatggtgagacgactcttgaggagcgagagtagtacgtccgccccgtataatggatgtcaccaatccactccattccctccctggggctgcggatccagcccaagaatgatcagaactgatggaaactccagagacagtgcagatgagagacagggttcccgaaggcctcaccagtcctgggcccggactcctgcagctgcccgggacaggacccatctgggagctgccaccgagcaggaggaaaaaccacaggtgcttcatgtcttgcacaggaggtccttgactctcagaaagccccaatccctaatcacgtgtatcgcaaatcgagcaccggtcgtgtatatactgttctgatggcgcgagggaggcggatacg

SEQ ID NO: 791380 - DNA, 590 bp, Homo sapiens
  misc_feature: 29550.44.78.H01.1.pb.heavy.1.raw 29550
ctatcgcccttgccagcccgctcagacgtatataggaagtatccttgaccaggcagcccagggccgctgtgctccggaggtgctcctggagcagggcgccagggggaagaccgatggcccttggtggaggctgaggagacggtgaccaggttccctggccccacaagtcaagccaggtgctggtggccttcgcacagaaatacacgcggccgtgtcctcagatctcaggctgctcagttccatgtaagactgtacctggggaggtgctcctggtcatactaactctgccttggaacttctgggcaagcccgtgttgccactatagggcttcatccatccatccactccagcccttgtccagcggcctgtcgcacccagttaatatcataattgatgaacgtgtatccagaagccgtgcaggagactgtcactgaggccccaggcttcttcacctcagccccagactgcaccagctgtacctgggagtgggaccgtcagtccttcctcttccccccaaaacccaaactactcacactaaatcgagcaccggtcgtgtatatactgtctgatggcgcgagggaggcgatacg

SEQ ID NO: 791381 - DNA, 544 bp, Homo sapiens
  misc_feature: 29564.44.38.D05.1.pb.heavy.1.raw 29564
ctatgcgccttgccagcccgctcagacagtatataggaagtagtccttgaccaggcagcccagggccgctgtgccccagaggtgctcctggagcagggcgccaggggaagaccgatgggcccttggtggaagctgaggagacggtgaccgtggtcccttggccccagacgtccataccgtagtagtagtatgcaactccccgaactcccgcaccggctcttgcacagtaatacacagccgtgtcctcggctctcagactgttcatttgcagatacagcgtgttcttggcgttgtctctgggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcggggacccccaggctgaactatcagatactaaatcgagcaccggtcgtgtatatactgtctgatggcgcgaggggaggcgatacg

SEQ ID NO: 791382 - DNA, 698 bp, Homo sapiens
  misc_feature: 29567.44.55.E11.1.pb.heavy.1.raw 29567
cgtatcgcctccctcgccgccatcagacagtataacacgaccggtgctcgatttagcactcgcacgttgggtttggggagaggagcccaggcactgggattcgaggtgtttccattcggtgatcagcactgaacacagaggactcaccatggagttttggctgagctgggttctccttgttgacttttaaaaggtgtccagtgtgaggtggcgctgatgagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaaggccgattcaccatctccagggacaattccaggacacggtttatcttcaaatgaacaacctgaggaggcgaccgacacggccgtctattactgtgcgagacaagtcggcgctcggagtggttattattcgtttgacttctggggccaggggacccctggtcaccgtcgcctccgccctccacaagggcccatcgtcttcccctggcaccctcctccaagagcacctctgggggcacagcggccctggctgcctggtcaagactacttcctatatactgtctgagcgggctggcaaggcgcatag

SEQ ID NO: 791383 - DNA, 680 bp, Homo sapiens
  misc_feature: 29578.44.45.E01.1.pb.heavy.1.raw 29578
cgtatcgcctccctcgcgccatcagacagtatatacacgaccggtgctcgatttagtgagtcagtaagggaaaggggctgggaaggagcccagcactagaagtcggcggtgtttccattcggtgatcagcactgaacacagaggactcaccatggagtttgggctgagctgggtttcctcgttgctcttttaagaggtgtccagtgtcaggttcagctggtggagtctgggggaggcgtggtccagcctggacgtccctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791384 - DNA, 656 bp, Homo sapiens
  misc_feature: 29579.44.23.C01.1.pb.heavy.1.raw 29579
cgtatcgcctccctcgcgccatcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtcctccaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 791385 - DNA, 723 bp, Homo sapiens
  misc_feature: 29598.UNK.UNK.UNK.pb.heavy.1.raw 29598
ctatgcgccttgccagcccgctcagacagtatataggaagtagtccttgaccaggcagcccagggccgctgtgccccagaggtgctcttggaggagggtgccagggggaagaccgatggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagcccaaacccaacgagctcactctaaatcgagcaccggttgtgtatatactgtctgatggcgcgagggaggcgatacg

SEQ ID NO: 791386 - DNA, 678 bp, Homo sapiens
  misc_feature: 29638.44.27.C05.1.pb.heavy.1.raw 29638
cgtatcgcctccctcgcgcatcagacagtatatacacgaccggtgctcgatttagacgcgatcgaagggtttgggggctgggagacgagcccagcactggaagtcgccggtgttttccactcggtgatcatcactgaacaagaggactcaccatggagttgggctgagctggttttcctcgttgcctcttaagaggtgtcatgtgtcaggtgcaatcgtggagtctggggggaggcgtggccccagtaggggggtccctgagactctcctgtgcagcctctggattcaccttcgataattggaatatgcagtgggtccgcaggctccaggcgagggctggagtgggtggcaggtgtgtcatttcatggaggaaatcaatctacggtgattccgttgagggccgattcaccatctccagagacaattccgagaacacagtgtctcttcaaatgaacagcctgagacctcaggacacgggccgtattttgtgcgagactatctgtttccaaaatcggttcattcgacgcctggggccagggaaccctggtcaccgtctctcggcctccacaagggcccatcgtcttcccctggcgcctgctccagagcacctccgagagcacagcggcctggctgcctggtcaaggactacttctatatatgtctgagcgggctggcaag

SEQ ID NO: 791387 - DNA, 645 bp, Homo sapiens
  misc_feature: 29650.UNK.UNK.UNK.pb.heavy.1.raw 29650
cgtatcgcctccctcgcgccatcagacagtatatacacgaccgtgctcgatttagtgctatagacttgggtttgggatgctttctgagagtcaaggacctcctgtgcaagaacatgaagcactgtggtttttcctcctgctgtggcagctcccagatgggtcctgtcccaggtgcagctgcaggagtcgggccaggactggtgaggccttcgggaaccctgtctctcatctgcactgtctctggagtttcatcagttctgatcattcttggggctggatccggcagcccccagggagggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggccgtgccaccctggtcactgtctcctcagcttccaccaagggcccatcgtcttcccctggcgcccctgctccaggagcacctctgggggcacagcggcctgggctgcctggtcaaggactacttcctatatactgtctgagcgggctggcaaggcgcatag

SEQ ID NO: 791388 - DNA, 711 bp, Homo sapiens
  misc_feature: 29664.44.36.D03.1.pb.heavy.1.raw 29664
cgtatcgcctccctcgcggccatcagacagtatatacacgaccggtgctcgatttagctgcgtcacgatctctcttggggagctctgagagcggagcccagccccagaattcccaggtgttttcatttggtgatcagcactgaacacagagactcaccatggagttcgggctgagctgggttttccttgttgttattttacaaggttgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactccattgattctggcgaatgactaacctgaaaaccgaggacacgggcatgtattattgtgttgtgtttatatcaggaaactgtcccactggggccagggaaccctggtccaccgtcttcctcagcctccaccaagggccatcggtcttccccctggcgccctgctccaggagcacctccgagagcacagcggccctgggctgcctggtcaaagaccacttcctatatactgtctgagcgggcctggcaaggcgcatag

SEQ ID NO: 791389 - DNA, 646 bp, Homo sapiens
  misc_feature: 29694.44.23.C01.1.pb.heavy.1.raw 29694
ctatgcgccttgccagcccgctcagacagtatataggaagtagtccttgaccaggcagcccagggccgctgtgcccccagaggtgctcctggagcagggcgccaggggaagaccgatggcccttggtggaagctgaggagacagtgaccagggtgccacggcccatagattgaaagaccagtctcgcctcgcacagaaataaacggccgtgtccgcggcggtcacggaggtcagtttcaggagaagcggttcatggacgtgtccctcgaaatggtgagacgactcttgagggacggagagtagtacgtcgccccagtataatggatgtcaccaatccactccattcccctccctggggctgccggatccagccaagaatgatcagaaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagccccaatccctaatcacgtgtactaaatcgagcaccggtcgtgtatatactgtctgatggcgcgagggaggcgatacg

SEQ ID NO: 791390 - DNA, 681 bp, Homo sapiens
  misc_feature: 29705.44.55.E11.1.pb.heavy.1.raw 29705
ctatgcgccttgccagcccgctcagacagtatataggaagtagtccttgaccaggcagcccagggccgctgtgcccccagaggtgctcttggaggagggtgccagggggagaccgatggcccttggtggaggcggaggcgacggtgacagggttcctggcccccagaagtcaaacgaataataacatcgagcgccattgtctcgcacagtaatagacggccgtgtcgtcgctccaggttgttcatttgaagataaagtgttctggattgtcctggaatggtgaatcggcccttcacggagtctgcgtagtatgtgaaatcaccagtataaatgactgagaccccaccccagccctccctgagcctggcggacccaactcattgtagttgctgctgacggggagcccagagctgcacaggagagtcctctgggacccccccccaggctggactaagctcctccagactccatcagcgcacctcacactgacaactttaaaaagccaacaagagacccagctcagcaaactccatgtgagtcctctgtgttcagtgctgatcaccgatggaaacacctcgaatcccagtgctgggctcctctccccccccaaaccaacgtgcgagtgctaaatcgagcaccggtcgtgtatatactgtctgatggcgcgagggaggcgatacg

SEQ ID NO: 791391 - DNA, 701 bp, Homo sapiens
  misc_feature: 29715.44.67.G01.1.pb.heavy.1.raw 29715
ctatgcgccttgccagcccgctcagacagtatataggaagtagtccttgaccaggcagcccagggccgctgtgcccccagaggtgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactcagccccttccctggagcctggcggacccaactcatgtagttgctgctgacggtgagcccagaggctgcacaggagagtctctggaccccccaggctggactaagcctcctccagactccatcagccgcacctcacactggacaccttttaaaagtccaacaaggagaaccagctcagccaaaactccatggtgagtcctctgtgttcagtgctgatcaccgaatggaaacacctcggaatcccagtgctgggctcctctccccccaaacccaatatgtatactctaaatcgagcaccggtcgtgtatatactgtctgatggcgcgagggaggcgatacg

SEQ ID NO: 791392 - DNA, 648 bp, Homo sapiens
  misc_feature: 29737.UNK.UNK.UNK.pb.heavy.1.raw 29737
cgtatcgcctccctcgcgccatcagacgacatatacacgcaccggtgctcgatttagtgctatagacttgggtttggggatgctttctgagagtcaaggaccctctgtgcaagaacatgaagcacctgtggtttttcctcctgctggtggcagctcccagatgggtcctgtccaggtgcagctgcaggagtccgggccagactggtgagcccttcgggaaccgctgtctcgtcatctgcactgtctctgggagtttccatcagttctgatcattcttggggctggatccggcagcccagggaggaggaatgagtggattgtgacatctgatccggacgacgtactactctccgtcctcaagagtcgtctccaccatttcgaggggaccacgtcatgaaccgcttctccctgaactgacctccgtgaccgccgcggacacggccgtttatttctgtgcgaggcgagactggtctttcaatctatggggccgtggcaccctgggtcactgtctcctcagcttccaccaagggcccatcggtcttccctggcgcctgctccaggagcacctctgggggcacagcggccctggcctgcctggtcaaggactacttcctatatactgtctgagcgggctggcaaggcgcatag

SEQ ID NO: 791393 - DNA, 579 bp, Homo sapiens
  misc_feature: 29745.UNK.UNK.UNK.pb.heavy.1.raw 29745
aggctgggcaggctatgcacctggtccaggtcaaagctgcggaacccgctagcgccatcttggccactagggtcccgcagattcatattgtcgtctagcatgcacaatgctgcaaacccagcttgcatgcccacagcaagcggccaatctttacgccacgttgaattgtttattacctgtgactgctatggctgcaacgccactcgtaaaactagtactttgcggttagggaagtagacaaccattactccactcccggaagttcaactcattccaacacgaaataaaagtaaactcaaccccaagcaggctatgtgggggtgataggggtggattctatttcctatcccatcccctaggatctcaatagttactagcgagttaaatgtctgtagcgatcccgtcagtcctatcgcgcgcatcaagacctggttggtgagcgtgcagtagatcatcgatagctgcgagttaggtcatccagacgcatctgcgcctaacgttcagtggtagctaagcgtcacttgactgtctaaaggcaatatgtcgtccttagctccaagtcctagcaagcgtgtcggg

SEQ ID NO: 791394 - DNA, 718 bp, Homo sapiens
  misc_feature: 29764.44.55.E11.1.pb.heavy.1.raw 29764
ctatgcgccttgccagcccgctcagacagtatataggaagtagtccttgaccagccaggcagccagggccgctgtgcccccagaggtggctcttggaggagggtgccagggggaagaccgatgggcccttggtggaggcggaggcgacggtgaccagggtttccctggcgcccagaagtcaaacgaataataaccactccgagcgccgacttgtctcgcacagtaatagacggccgtgtcgtcgcctctcaggttgtttcatttgaagataaccgtgttcctggaattgtccctggagatggtgaatcggccctctcacggagtctgcgtagtatgtgaaatcaccagtataaatgactgagacccactccagccccttccctggagcctggcggacccaactcatgtagttgctgctgacggtgagcccagaggctgcacaggagagtctctgggacccccccaggctggactaagcctcctccagactccatcagccgcacctcacactggacaccttttaaaagtccaacaaggagaacccagctcagccaaaactccatggtgagtcctctgtgttcagtgctgatcaccgaaatggaaacacctcggaatcccagtgctgggctcctctctcccccccaaacccaacgtgcgagtgctaaatcgagcaccggtcgtgtatatactgttctgatggcgcgagggaggcgatacg

SEQ ID NO: 791395 - DNA, 600 bp, Homo sapiens
  misc_feature: 29774.UNK.UNK.UNK.pb.heavy.1.raw 29774
ccgacacgcttgctagggacttggagctaaggacgacatattgcctttagacagtcgaaggtgacgccttagctacactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcaccccccacatagcctgcttggggtgttgagtttacttttatttcgtgttggaatgagttgaacttccgggaagtggagtaatgggtttgtctacttcccctaaccgcaagtactagttttacgagtggcgttgcaagccatagccagtcacaggtaataaacaattcaacgtggcgtaaagattggccgcttgctgtggcattgcaagctgggttgcagcattgtgcatgctagacgacaatatgaatctgcgggaccctagtgccaagatggcgctagcgggttccgcagcttttgaccctggaccagggtgcatagcctgcccagccttc

SEQ ID NO: 791396 - DNA, 615 bp, Homo sapiens
  misc_feature: 29859.UNK.UNK.UNK.pb.heavy.1.raw 29859
gaaggctgggcaggctatgcaccctggtccaggtcaaaagctgcggaacccgctagcggccatcttggccacctaggggtcccgcagattcatattgtcgtctagcatgcacaatgctgcaaacccagcttgcaatgccacagcaagcggccaatctttacgccacgttgaattgtttattacctgtgactggctatggcttgcaacgccactcgtaaaaactagtactttgcggttaggggaagtagacaaacccattactccacttcccggaagttcaactcattccaacacgaaataaaagtaaactcaacaccccaagcaggctatgtggggggtgatagggggtggattctatttcctatcccatcccctaggatctcaattaagttactagcggagttaaatgtctgtagcgatcccgtcagtcctaatcgcgcgcatcaagacctgggttggttgagcgtgcagtagatcatcgataaggctgcgagttaggtcatccccagaccgcatctggcgcctaaacgttcagtggtagctaaggcgtcaccttcgactgtctaaaggcaatatgtcgtccttagctccaagtccctagcaaggcgtgtcggg

SEQ ID NO: 791397 - DNA, 650 bp, Homo sapiens
  misc_feature: 29915.44.86.H09.1.pb.heavy.1.raw 29915
cgtatcgcctccctcgcgccatcagacagtatatacacgaccggtgctcgatttagtgctatagacttgggtttggggatgcttctgagagtcaaggacctcctgtgcaagaacatgaagcacctgtggtttttcctcctgctggtggcagctcccagatgggtccgtcccaggtgcagctgcaggagtcgggcccaggactggtgaggccttcggaaccctgtctctcatctgcactgtctctggagtttccatcagttctgatcattcttggggctggatccggcagccccccagggaggggaatggagtggattggtgacatccattatactggggcgacgtactactctccgtcctcaagagtcgtctcaccatttcggacggggacacgtcatgaaccgcttctcctgaaactgacctccgtgaccgccgcggacacggccgtttatttctgtgcgaggcgagactggtctttcaatctatggggccgtgcaccctggtcactgtctcctcagcttccaccaagggcccatcggtcttcccctggcgccctgctccaggagcacctctgggggcacagcggccctgggctgcctggtcaaggactacttcctatatactgtctgagcgggctggcaggcgcatag

SEQ ID NO: 791398 - DNA, 676 bp, Homo sapiens
  misc_feature: 29954.44.71.G05.1.pb.heavy.1.raw 29954
ctatgcgccttgccagcccgctcagacagtatataggaagtagtccttgaccaggcagcccagggccgctgtgccccccagaggtgctcttggaggagggtgccagggggaagaccgatgggcccttggtggaggctgaggagacggtgaccggggtccctttgccccagacgtccatgtagtagtaatacttgtattgttgtaaacttctgcgaccctctggcacagtaataaagggccgtgtcgtccactcgcaggctcttcatctgcagaaacaccgtattcttggaattgtccctggagacgatgagcggcccttcacggagtctgcgacatttgtggcactaccaccagtaatggatgagacccactccagccccttccctggggcctgacggacccagatcatggcataggtattaaaggcgaatccagaggctgcacaggagagtgtcagggacccccccggctgtaccaagcctccccccgactccaacagctgcacttcacactggacaccttttaaaacagccacaagaaaaagccagctcagcccaaactccatggtgagttctctctgttcagtccccagggctgggctcctctctcttgcgacgacactaaatcgagcaccggtcgtgtatatactgtctgatggcgcgagggaggcgatacg

SEQ ID NO: 791399 - DNA, 694 bp, Homo sapiens
  misc_feature: 29956.44.27.C05.1.pb.heavy.1.raw 29956
ctatgcgccttgccagcccgctcagacagtatataggaagtagtccttaccaggcagcccaggccgctgtgctctcggaggtgctcctggagcagggcgccagggggaagaccgatgggcccttggtggaggccgaggagacggtgaccagggttccctggccccaggcgtcgaatgaaccgatttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagccctcgcctggagcctggcggacccactgcatattccaattatcgaaggtgaatccagaggctgcacaggagagtctcagggacccccctactggggcacgcctccccagactccacgaattgcacctgacacatgaccctcttaaagagggcaacgaggaaacccagctcagcccaaacccatggtgagtcctctgtgttcagtgatgatcaccgagtggaaacaccggcgcttccagtgctgggctcgtctccaggcccaaacccttcgatcgcgtctaaatcgagcaccggtcgtgtatatactgtctgatggcgcgagggaggcgatacg

SEQ ID NO: 791400 - DNA, 652 bp, Homo sapiens
  misc_feature: 29981.44.23.C01.1.pb.heavy.1.raw 29981
ctatgcgccttgccagcccgctcagacagtatataggaagtagtccttgaccaggcagccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcgcggcggtcacggaggtcagtttcagggagaagcggttcatggacgtgtccctcgaaatggtgagacgactcttgagggacggagagtagtacgtcgcccccagtataatggatgtcaccaatccactccattcccctccctgggggctgccggatccagcccaagaatgatcagaactgatggaaactccagagacagtgcagatgagagacagggttcccgaaggcctcaccagtcctggcccgactcctgcagctgcactgggacaggacccatcctggagctgccaccagcaggaggaaaaaccacaggtgcttcatgttcttgcacaggaggtccttgactctcagaaagcccccaatccctaatcacgtgtactaaatcgagcaccggtcgtgtatatactgtctgatggcgcgagggaggcgatacg

SEQ ID NO: 791401 - DNA, 715 bp, Homo sapiens
  misc_feature: 30013.UNK.UNK.UNK.pb.heavy.1.raw 30013
ctatgcgccttgccagccgcccgctcagacagtatataggaagtagtccttgaccaggcagcccagggccgctgtgcccccagaggtgctcttggaggagggtgccagggggaagaccgatgggccttggtggaggcggaggcgacggtgaccagggttccctggccccagaagtcaaacgaataataaccactccgagcgccgacttgtctcgcacagtaatagacgcgccgtgtcgtcgccctctcaggttgttcatttgaagataaaccgtgttcctgggaattgtccctggagatggtgaatcggcccttcacggagtctgcgtagtatgtgaaatcaccagtataaatgactgagaccgcactcagccccttccctggagcctggcggacccaactcatgtagttgctgctgacggtgagccccagaggctgcacaggagagtctctgggacccgccccaggctggactaagcctcctccagactccatcagccgcaccctcacactggacaccttttaaaagtccaacaaggagaacccagctcagccaaaactccatgtgagtcctctgtgttcagtgctgatcaccgaatggaaacacctcggaatcccagtgctgggctcctctccccaaacccaacgtgcgagtgctaaatcgagcacccgggtcgtgtatgatactgtctgatggccgcgagggaggcgatacg

SEQ ID NO: 791402 - DNA, 572 bp, Homo sapiens
  misc_feature: 30056.44.78.H01.1.pb.heavy.1.raw 30056
ctatgcgccttgccagcccgctcagacagtatataggaagtagtccttgaccaggcagccagggccgctgtgctctcggaggtgctcctggagcagggcgccagggggaagaccgatgggccctggtggaggctgaggagacggtgaccagggttccctggcccccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggcttcttcacctcagcagcgtggtgaccgtgacctccagcaacttcggcacccaaacccaaactactcacactaaatcgagcaccggtcgtgtatatactgtctgatggcgcgagggaggcgatacg

SEQ ID NO: 791403 - DNA, 671 bp, Homo sapiens
  misc_feature: 30067.UNK.UNK.UNK.pb.heavy.1.raw 30067
tcgtatcgaccgtcccgttcgcgcccatcagaccagtatatacacgaccggtggccgatttagtagtgtgattccgcggggctttctgagagtcatggactcctcctgcaagacatgaagcacctgtggttcttcctcctgcctggtggcggctcccagatggtcctgtcccagctgcagctgcaggaacgggcccaggaatggtgaagccttcgagaccctgtcctcactgccactgtctctggtggctccatcagcagtaagtagttactactggggctggatcgccagcccccagggaagggggctggagtggattgggagtatctattatatagtggggagcacctactacaacccgtccctcaagagtcgagtcaccatatcagtagacacgtccaagaacccagttctccctgaagctgagctctgtgacgcccgcggacacggcccgtgtttactgtgcgagagtagggcaaagttcgtcaccaaactactttgaccactggggccagggaaccctggtcaccgtctcctcagcctccaccaagggcccatcggtcttcccctggcacctcctccaagagcacctctggggcacagcggccctgggctgcctggtcaaggactacttcctatatactgtctgagcggtgctggcaggcgcatag

SEQ ID NO: 791404 - DNA, 652 bp, Homo sapiens
  misc_feature: 30122.UNK.UNK.UNK.pb.heavy.1.raw 30122
ctatgcgccttgccagcccgctcagacagtatataggaagtagtccttgaccaggccagccagggccgctgtgctctcggaggtgctcctggagcagggcgccagggggaagacgatgggcccttggtggaggctgaggatgaggagacggtgaccgtggtcccttggccccagacgtcccaagccgtagtagaattgagacgacctgccataggcggacccatgtcctgacacagtagtagacagccgtgtcggcggcggccacagaactcactttcagggaaaactgtgtcctcgacgtgtccacgatatggtgactcgaccgttgaggacgggttgtagtaggtgttcccactataatagagactcccaatccactgcagccctctcctggggctggcggatccagccccagtagaaattacttctgtcgatggaggcaccagagaccgtgcacgtgagggacagggtctccgaaggcttcaccagtctgggccccgactccgcagctgcggctgagacaggacccatctgggagccgccaccagcaggaggagaaccacagtgtcttcccccaaaccaacacaactctctctaaatcgagcacccggtcgtggtatatactgtctgatggcgcgagggaggcgatacg

SEQ ID NO: 791405 - DNA, 649 bp, Homo sapiens
  misc_feature: 30124.UNK.UNK.UNK.pb.heavy.1.raw 30124
ctatgcgccttgccagccgctcagacagtatataggaagtagtccttgacaggcagcccaggccgctgtgctctcgaggtgctctggagcaggcgccaggggaagacgatgggccttggtggaggctgaggagacggtgaccaggttccctggccgaatgaaccatcccagacagtaatagacggctgtgtcctcggtgttcaggctgttcatctgcagagacaccgtatctttgaatcatctcttgagatggtgaatctgcctttcacgggtgcagcgtagtctgctgtccaccgtcagctttgttctatacgcaacccactccagcccttccctggagcctggcggaccaggtcatccaggcgtactgaagtgaatccagaggctgcacaggagagtctaaggactcccaggctttacaaacctccccagactccaccactgcacctcacactggacacctttaaatagcagcaaggaaaatccagctcagcccaaactccatgtgagtcctctgtgttcagtcctgatcactgaatgaaaacacctggaatccaaggctggggctcctctcccagagctcaacacactctctctaaatcgagcaccgtcgtgtatatactgtctgatggcgcgaggaggcgatacg

SEQ ID NO: 791406 - DNA, 696 bp, Homo sapiens
  misc_feature: 30138.44.73.G07.1.pb.heavy.1.raw 30138
cgtatcgcctcctcgcgccatcagacagtatatacacgaccggtgctcgattagctctacgctcaggggagctctgggagaggagcccagcactagaagtcggcggtgtttccattcggtgatcagcactgaacacagaggactcaccatggagtttgggctgagctgggttttcctcgttacttttaagaggtgtccagtgtcaggtgcacctggtggagtctggggaggcgtggtccagcctgggaggtccctgagactctcctgtgaagcctctggatttagtttcagtagttctggcatgcactgggtccgccaggctccaggcaagggccggagtggtggcagttatagcatatgatggaacttctagatattatgcagactccgtgaagggccgattcaccatctccagagacaattcccggaacactctgtacctggaaatgatcagcctgagaggcgaggactcggctctgtattactgtgcgagatcgggaagtggcagcagctattatcgggcgtttcactgggccagggacactggtcaccgtctcctcagcctccaccaagggcccatcggtcttccccctggcgccctgctccaggatcacctccgagagcacagcggccctgggctgcctggtcaaggactacttcctatatactgtctgagcgggctggcaaggcgcatag

SEQ ID NO: 791407 - DNA, 681 bp, Homo sapiens
  misc_feature: 30208.44.27.C05.1.pb.heavy.1.raw 30208
cagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgatttggaaacagatagtctcgcacaaaaatacacggccgtgtcctgaggtcctcaggctgttcattgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagggctccccaaacccttcgatcgcgtctaaatcgagcaccggtcgtgtatatactgtctgatggcgcgagggaggcgatacg

SEQ ID NO: 791408 - DNA, 705 bp, Homo sapiens
  misc_feature: 30217.44.74.G08.1.pb.heavy.1.raw 30217
ctatgcgccttgccagcccgctcagacagtatataggaagtagtccttgaccaggcagcccagggccgctgtgcccccagaggtgctcctggagcagggcgccagggggaagaccgatgggcccttggtggaagctgaaggtgacaatgaccagggtttcctgcccccagatctcaaaggctccatgcgagctggggtacggacctctcgcacagtagtagacggccgtgtcgtcggatttcaaagaactcattgtccatggagactgtgtctgtggacttgtccgcggtaatcgtaattctgccccggaagtctcgtgcgtaaggtgagtgagccaaaaagaggatgattccacccatccactcaagcccttgtccaggggcctggcgcacccagttgatggtataaagtagtggaactggtagtacttccagaggccgtgcaggaaagggtcaccgaggaccaaggttgcggcattctagtcccagactgcaccagttggccaccagggactggacacctgtttgctgctgccacccacaaagaggaacctccaggtccagtccatggtgatgagctgtgctcccaggggctctttagaggaggaatgtggttgttatgtgatggctccccctgatagagctactaaatcgagcaccggtcgtgtatatactgtctgatggcgcggcagggaggcgatttacg

SEQ ID NO: 791409 - DNA, 629 bp, Homo sapiens
  misc_feature: 30224.UNK.UNK.UNK.pb.heavy.1.raw 30224
cgtatcgcctcctcgcgccatcagacagtatatacacgacggtgctcgatttagtacacgtgattagggatgggggctttctgagagtcaaggacctcctgtgcaagaacatgaagcacctgtggttttcctcctgctggtggcagctccagatgggtcctgtcccaggtgcagctgcaggagtcgggcccaggactggtgaggccttcggaaccctgtctctcatctgcactgtctctggagtttccatcagttctgatcattcttgggctggatccggcagccccagggaggggaatggagtggattggtgacatccattatactgggcgacgtactactctccgtcctcaagagtcgtctcaccatttcgagggacacgtcatgaaccgcttctccctgaaactgacctccgtgaccgcgcggacacgccgtttatttctgtgcgaggcgagactgtcttcaatctatggggcgtggcaccctggtcactgtctcctcgcttccacaagggcccatcggtcttcccctggcgccctgctccaggagcacctctggggcacagcgcctggctgcctggtcaagactacttcctatatactgtctgagcgggctggcaaggcgcatag

SEQ ID NO: 791410 - DNA, 708 bp, Homo sapiens
  misc_feature: 30233.UNK.UNK.UNK.pb.heavy.1.raw 30233
cgtatcgcctccctcgcgccatcagacatatatacacgacggtgctcgatttagagtatacatattggttttggggggagaggagccccagcactgggattccgagtgtttcattcggtgatcagcactgaacacagaggactgcacatggagtttgggctgagcctgggttctccttgttgacttttaaaggtgtcctagtgtgaggtgcggctgatggagtctggaggaggcttagttccagcctggggggtcccagagactctcctgttgcagcctctggctcaccgtcagcagcaactacatgagttgggtccgcccaggctccagggaaggggctggagtgggtctcagtcttttatactggtgattcacatactacgcaggactccgtgaagggccgattcaccatctccagggacaattccaggaacacggtttatctttcaaattgaacaacctgagaggcgacgacacggccgtctattactgtgcgagacaagtcggcgctcggagtgtttattaattcgtttgacttctggggccaggaaccctggtcaccgtgcctccggcctccaccaagggcccatcggtcttccccctggcaccctcctccaagagcacctctgggggcacagcggccctgggcctgcctggttcaaggactacttcctatattactgtctgagcggctggcaaggcgcatag

SEQ ID NO: 791411 - DNA, 707 bp, Homo sapiens
  misc_feature: 30240.UNK.UNK.UNK.pb.heavy.1.raw 30240
cgtatcgcctccctcggcgccatcagacagtatatacacgaccggtgcctcgattttagctgcgtcacgatctctcttggggagctctgagagcggagccccagccccagaattccaggtgttttcatttggtgatcagcactgaacacagaggactcaccatggagttcgggctgagctgggttttcctgttgttattttacaaggtggtccagagtgaagtgcagttggtggagtccggggagacttggtccagccgtgagggtccctggagactctcctgtgtcgcctctggattcaccatccagtgaccactatatggactgggtccgccaggctccaggaagggctgagtggcttggccgcagtaaaaacaaagttgccagctttatcacagagtacgccgcgtctgtgaaagccagattcacccttcaagagatgacttcaaagaactcattgatcttgcgaatgactaacctgaaaaccgaggacacggggcatgtatttattgtgttgtgtttatatcaggaactgtccactggggccagggaaccctggtcaccgtctctcagcctccaccaaggcccatcggtcttcccctggcgccctgctccaggagcaccctccggagagcacagcggccctgggctgcctggtcaaaggactacttcctatatactgtctgagcgggctggcaaggcgcatag

SEQ ID NO: 791412 - DNA, 599 bp, Homo sapiens
  misc_feature: 30270.UNK.UNK.UNK.pb.heavy.1.raw 30270
gaaggctggcaggctatgcaccctggtccaggtcaaaagctgcggaacccgctagcggccatcttggccactagggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttagggaagtagacaaacccattactcacttcccgaagttcaactcattccaacacgaaataaaagtaaactcaacaccccaagcaggctatgtgggggggtgatagggtggattctatttcctatccatccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcgg

SEQ ID NO: 791413 - DNA, 660 bp, Homo sapiens
  misc_feature: 30274.44.12.B01.1.pb.heavy.1.raw 30274
cgtatcgcctcctcgcgccatcagacagtatatacacgaccggtgctcgatttagtagtgtagattccgcgggggctttctgagagtcatggacctctgtgcaagaacatgaagcacctgtggttcttcctcctgctggtgggcggctcccagatgggtcctgtcccagctgcagctgcaggagtcgggcccaggactggtgaagccttcggagacctgtcctcacctgcactgtctctggtggctccatcagcagtagtagttacactggggctggatccgccagcccccagggaaggggctggagtggattgggagtatctattatagtgggagcacctactacaacccgtccctcaagagtcgagtcaccatatcagtagacacgtccaagaaccagttctccctgaagcctgagctctgtgaccgccgcggacacggccgtgtattactgtgcgagagtagggcagttcgtcaccaactactttgaccactggggccagggaaccctggtcaccgtctcctcagcctccaccaagggcccatcggtcttcccctggcaccctcctccaagagcacctctgggggcacagcgccctgggctgcctggtcaaggactacttcctatatactgtctgagcgggctggcaaggcgcatag

SEQ ID NO: 791414 - DNA, 662 bp, Homo sapiens
  misc_feature: 30299.44.6.A06.1.pb.heavy.1.raw 30299
atgcgccttgcagcccgctcagacagtatataggaagtagtccttgaccaggcagcccagggccgctgtgccccagaggtgctcctggagcagggcgccaggggaagaccgatgggcccttggtggagctgaggtgacaatgaccagggttccctgccccccagatctcaaaggctcatgcgagctgggtacggacctctcgcacagtagtagacggccgtgtcgtcggatttcaaagaactcattgtcatggagactgtgtctgtggacttgtccgcggtaatcgtaattctgcccggaagtctcgtgcgtaggtgagtgagccaaaagagggatgattccacccatccactcaagcccttgtccagggcctggcgcacccagttgatggtataagtagtggaactggtagtacttccagaggccgtgcaggaaagggtcaccgaggaccaaggttgcggcattctagtcccagactgcaccagttgcacaggactggacacctgttgctgctgccaccacaaagaggaacctccaggtcagtccatggtgatgagctgtgctcccaggggcttctttagaggaggaatgtggttgtcagtagatctaaatcgagcaccggtcgtgtatatactgtctgatggcgcgaggaggcgattacg

SEQ ID NO: 791415 - DNA, 605 bp, Homo sapiens
  misc_feature: 30327.UNK.UNK.UNK.pb.heavy.1.raw 30327
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttactttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtggcattgcaagctgggtttgcagcattgtgcatgctagacgacaatatgaatctgcgggacccctagtggccaagatggccgctagcgggttccgcagcttttgacctggaccagggtgcatagcctgcccagcctc

SEQ ID NO: 791416 - DNA, 663 bp, Homo sapiens
  misc_feature: 30339.44.12.B01.1.pb.heavy.1.raw 30339
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtaggcagtttcgtcaccaactactttgaccactggggccagggaaccctggtcaccgtctcctcagcctccaccaagggcccatcggtcttcccctggcaccctcctccaagagcacctctgggggcacagcggcctgggctgcctggtcaaggactacttcctatatactgtctgagcgggctggcaaggcgcatag

SEQ ID NO: 791417 - DNA, 685 bp, Homo sapiens
  misc_feature: 30372.UNK.UNK.UNK.pb.heavy.1.raw 30372
cgtatcggcctcccctcggcgccatcagacagtatatatacacgaccggtgctcgatttagtagtgtaagattccgcgggggctttctgagagtcatggaccctcctgtgcaagaacatgaagcactgtggttcttcctcctgctggtggcggctcccagatgggtcctgtcccagctgcagctgcaggagtcgggcccaggactggtgaaagccttcggagaccctgtccctcacctgcactgtctctggtggctccatcagcagtagtagttactactggggctggatccgccagcccccagggaaggggctggagtggattgggagtatctattatagtgggagcaccctactacaaacccggtccctcaagagtcgagtcaccatatcagtagacaccgtccaaggaaccagttctccctgagctgagctctgtgaccgccgcggaaccggccgtgtattactgtgcgaagagtagggcagtttcgtcaccaactactttgaccactggggccagggaaaccctggtcaccgtctcctcagcctccaccaaggggcccatccggtcttccccctggcaccctcctccaagaggcacctctgggggcaacagcggccctggggctgcctggtcaagacttaccttcctatatactgtctgagcgggctggcaaggcgcatag

SEQ ID NO: 791418 - DNA, 720 bp, Homo sapiens
  misc_feature: 30373.UNK.UNK.UNK.pb.heavy.1.raw 30373
cgtatcgcctccctcgcgccatcagtcgttatcactatcactgaccggtgctcgatttagctgcgtcacgatcttctcttggggaagctctgagagcggagccccccagcccccagaattcccaggtgttttcatttgtgattcagcactgaacacagaggactcaccatggagtttcgggcgagctgggttttccttgtgttatttttacaaggtgtccagagtgaagtggcagttggtggagtccggggagacttggtccagcctggagggtccctgagactctcctgtgtcgcctctgatttcaccatcagtgaccactatatggactgggtccgccagctccagggaagggctggagtggcttggccgcaggtaaaaacaaagttgccagcctttatcacagagtacgccgcgtccttgtgaaagccagatttcaccctctcaaggagatgacttcaagaactcattgatttctgcgaatgactaacctgaaaaccgaggacacgggcatgtattattgtgttgtgttatatcaggaactgtccactggggccagggaaccctggttcaccgtctcctcagccttccaccaagggcccatcggtcttccccctggcgcctgctccaggagcacctccgagagcacagcggccctgggctgcctggtccaaggactacttcctatatactgtctgagcgggctggcaaggcgcatag

SEQ ID NO: 791419 - DNA, 680 bp, Homo sapiens
  misc_feature: 30390.44.45.E01.1.pb.heavy.1.raw 30390
ctatgcgccttgccagcccgctcagacgatattaggaagtagtctttgaccaggccagcccaggcgcgctgtgctctcgaggtgctcctggagcagggcggccagggggaagaccgatggggcccttgtgaggcctgaggagacggtgaccagggctccctggccccaggtagaacgatgggctcgtacaataatagagagccgagtcctcggctctccaattgttcatttgtagatacacggtgttcttggaattgtctctggagacggagaatcggcccttcacgggagtttccatagtatcttacttccatcagagaccagatgactgccacccactccagccccattgcctggagcctggcggacccagtgcatggcagagtcactgaactgagtccggacgcaacacaggagagtctcagggacgtcccggctggaccacgcctccccagactccaccagctgaacctgacactggacacctcttaaaagagcaacgaggaaaacccagctcagccccaaactccatggtgagtcctctgtgttcagtgctgatcacgaatggaaacaccgccgacttctagtgctgggctcctctcccagcccctttccttactgactcactaatcgagcaccggtcgtgtatatactgtctgatggcgcgaggaggcgatacg

SEQ ID NO: 791420 - DNA, 710 bp, Homo sapiens
  misc_feature: 30392.44.27.C05.1.pb.heavy.1.raw 30392
cgtatcgcctccctcgcgccatcagacagtatatacacgaccggtgctcgatttagacgcgatcgaagggtttggggcctgggagacgagcccagcactggaagtcgccggtgttttccactcggtgatcatcactgaacacagaggactcaccattggagtttgggctgagctgggttttcctcgttgccctctttaagaggtgtcatgtgtcaggtgcaaattcgtggagtctgggggaggcgtgggcccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgttttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791421 - DNA, 605 bp, Homo sapiens
  misc_feature: 30394.UNK.UNK.UNK.pb.heavy.1.raw 30394
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttgggtgttgagtttacttttatttcgtgttggaatgagttgaacttccgggagtggagtaatggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggaccctagtggccaagatggcccgctagcgggttccgcagcttttgacctggaccagggtgcatagcctgcccagccttc

SEQ ID NO: 791422 - DNA, 702 bp, Homo sapiens
  misc_feature: 30406.44.36.D03.1.pb.heavy.1.raw 30406
cgtatcgcctccctcgcgccatcagacagtatatacacgaccggtgctcgatttagctgcgtcacgatctctcttgggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaagggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 791423 - DNA, 687 bp, Homo sapiens
  misc_feature: 30410.UNK.UNK.UNK.pb.heavy.1.raw 30410
ctatgcgccttgccagcctgctcagacagtatataggaagtagtccttgaccaggcagcccagggccgctgtgccccagaggtgctctggaggagggtgccagggggaagaccgatggcccttggtggaggcggaggcgacggtgaccagggttccctggcccagaagtcaaacgaataataaccactccgagcgccgacttgtctcgcacagtaatagacggccgtgtcgtcgcctctcaggttgttcatttgaagataaacgtgttcctggaattgtccctggagatggtgaatcggcccttcacggagtctgcgtagtatgtgaaatcaccagtataaatgactgagacccactccagccccttccctggagcctggcgacccaactcatgtagttgctgctgacggtgagcccagaggctgcacaggagagtctctgggacccccaggctggactaagcctcctccagactccatcagccgcacctcacactggacaccttttaaagtccaacaaggagaacccagctcagccaaaactccatggtgagtcctctgtgttcagtgctgatcaccgaatggaaacacctcgaatcccagtgctgggctcctctccccaaacccaacgtgcgagtgctaaatcgagcacggtatatactgtctgatggcgcgaggaggcgatacg

SEQ ID NO: 791424 - DNA, 612 bp, Homo sapiens
  misc_feature: 30417.44.23.C01.1.pb.heavy.1.raw 30417
ctatgcgccttgccagcccgctcagacagtatataggaagtagtccttgaccaggcagcccagggcgctgtgccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgcccagtataatggatgtcaccatccactccattcccctccctggggctgccggatccagcccaagaatgatcagaactgatggaaactccagagacagtgcagatgagagacagggttccgaaggcctcaccagtcctgggcccgactcctgcagctgcacctgggacaggacccatctggagctgccaccagcaggaggaaaaaccacaggtgttcaccctgccccaatccctaatcacgtgtactaaatcgagcaccggtcgtgtatatactgtctgatggcgcgagggaggcgatacg

SEQ ID NO: 791425 - DNA, 730 bp, Homo sapiens
  misc_feature: 30468.44.33.C11.1.pb.heavy.1.raw 30468
ctatgcgccttgccagcccccgctcagacagtatataggaagtagtccttgaccaggcagccagggccgctgtgcccccagaggtgctcttggaggagggtgccagggggaagaccgatggcccttggtggaggctgaggagaccggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacgaaatctacataatatttattacttccatcataccatataagtgccacccactccagtcccttgcctggagcctgacggacccagtgcatgccatgtctgttgaaggtgaatccagacgctacacaggagagtctcaggacctcccaggctggaccacgcctccccagactccaccagcttcacctgacactggacacctcttaaaagagcaacgaggaaaacccaggtcagcccaaactccatggtgagtcctctgtgttcggtgctgatcaccgactggaaacacgccgacttctgtggctgggctctgtctcccagagctccccaaacccaacgagctcactctaaatcgagcaccggtcgtgtatatactcgtctgatggcgcgagggaggcgatacg

SEQ ID NO: 791426 - DNA, 698 bp, Homo sapiens
  misc_feature: 30479.44.55.E11.1.pb.heavy.1.raw 30479
ctatgcgccttgccagccgctcagacagtatataggaagtagtccttgaccaggcagcccagggccgctgtgcccccagaggtgctcttggaggaggtgccaggggaagaccgatgggcccttggtggaggcggaggcgacggtgaccagggttccctggccccagaagtcaaacgaatataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcacagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtcaacaaggagaacccagctcagccaaaactccatggtgagtcctctgtgttcagtgctgatcaccgaatggaaacacctcgaatcccagtgctgggctcctctccccccaaacccaacgtgcgagtgctaaatcgagcaccggtcgtgtatatactgtctgatggcgcgagggaggcgatacg

SEQ ID NO: 791427 - DNA, 666 bp, Homo sapiens
  misc_feature: 30496.44.12.B01.1.pb.heavy.1.raw 30496
cgtatgcgcctccctcgccgccatcagacagtatatacacgaccggtgctcgattagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactgggggctggatccgcccagccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactgggggccagggaaccctggtcaccgtctcctcagcctccaccaagggcccatcggtcttcccctggcaccctcctccaagagcacctctgggggcacagcggccctgggctgcctggtcaaggactacttcctatatactgtctgagcgggctggcaaggcgcatag

SEQ ID NO: 791428 - DNA, 696 bp, Homo sapiens
  misc_feature: 30543.44.36.D03.1.pb.heavy.1.raw 30543
ctatgcgccttgccagcccgctcagacagtatataggaagtagtcctgaccaggcagcccagggccgctgtgctctcggaggtgctcctggagcagggcgcccagggggaagaccgatgggccttggtggagctgaggagacggtgaccagggttccctggccccagtggacagttcctgatataaacacaaccaataatacatgcccgtgtcctcggttttcagttagtcattcgcagaatcaatgagttcttgaagtcatctcttgagaggtgaatctggctttcacagacgcggcgtactctgtgataaagctggcaactttgtttttactgcggccaagccactccagcccttccctggagcctggcggacccagtccatatagtggtcactgatggtgaatcagaggcgacacaggagagtctcagggacccctccaggctggaccaagtctccccggactccaccaactgcacttcactctggacaccttgtaaaataacaacaaggaaaacccagctcagcccgaactccatggtgagtcctctgtgttcagtgctgatcaccaaatgaaaacacctggaattctgggctggggctccgctctcagagctccccaagagagatcgtgacgcagctaaatcgagcaccggtcgtgtatatactgtctgatggcgcgagggaggcgatacg

SEQ ID NO: 791429 - DNA, 671 bp, Homo sapiens
  misc_feature: 30555.UNK.UNK.UNK.pb.heavy.1.raw 30555
cgtatcgcctccctcgcgcccgaccggtgctcgatttagtagctctatcagggagcatcacataacaaccacattcctcctctaaagaagcccctgggagcacagctcatcaccatggactggacctggaggttctctttgtggtggcagcagcaacaggtgtccagtccctggtgcaactggtgcagtctgggaactagaatccgcaaccttggtcctcgtgaccctttcctgcacggcctctggaaagtactaccagttccactacttataccatcaactgggtgcgccaggcccctggacaagggcttgagtggatggtggaatcatcctctttttggctcactcacctacgcacgagacttccgggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcacctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 791430 - DNA, 539 bp, Homo sapiens
  misc_feature: 30603.44.38.D05.1.pb.heavy.1.raw 30603
cgtatcgcctcctcgcgccatcagacagtatatacacgaccggtgctcgatttagtatctgatagttgggtttgggggtccctgagactctcctgtgcagcctctggattcaccttcagtaagctactggatgcactgggtccgccaagctccagggaaggggctgtgtgggtctcacgtattaatagtgatgggagtagcacaagctacgcggactccgtgaagggccgattcaccatctccagagacaaacgcaagaacacgctgtatctgcaaatgaacagtctgagagccgaggacacggctgtgtattactgtgcaagagccggtgcgggagttcggggagttgcatactactactacggtatggacgtctggggcaagggacacggtcaccgtctcctcagcttccaccaagggcccatcgtcttccccctggcgccctgctccaggagcacctctgggggcacagcgccctgggctgcctggtcaaggactacttcctatatactgtctgagcgggctggcaaggcgcatag

SEQ ID NO: 791431 - DNA, 601 bp, Homo sapiens
  misc_feature: 30606.UNK.UNK.UNK.pb.heavy.1.raw 30606
gaaggctgggcaggctatgcaccctggtccaggtcaaaagctgcggaacccgctagcggccatcttggccactaggggtcccgcagattcaattgtcgtctagcatgcacaatgcgcaaacccagcttgcaatgcccacagcaagcgccaatctttcgccacgttgaattgtttattacctgtgactggctatgcttgcaacgccactcgtaaaactagtactttgcggtttaggggaagtagacaaacccattactccacttcccggaaagttcaactcattccaacacgaaataaagtaaactcaacaccccaagcagctatgtggggggtgataggggtggattctatttcctatccatccctaggatctcattaagttactagcgagttaaatgtctgtagcgatcccgtcagtcctatcgcggcgcatcaagacctggttggttgaggcgtgcagtagatcatcgataagctgcgagtttaggtcatcccagaccgcatctggcgcctaaacgttcagtggtagctaaggcgtcaccttcgactgtctaaaggcaatatgtcgtccttagctccaagtcctagcaagcgtgtcggg

SEQ ID NO: 791432 - DNA, 651 bp, Homo sapiens
  misc_feature: 30643.44.86.H09.1.pb.heavy.1.raw 30643
cgtatcgcctccctcgcgccatcagacagtatatacacgaccggtgctcgatttagtgctatagacttgggtttgggatgctttctgagagtcaaggacctcctgtgcaagaacatgaagcacctgtggtttttcctcctgctggtggcagctcccagatgggtcctgtccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgagcgagactggtctttcaatctatggggccgtggcaccctggtcactgtctcctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 791433 - DNA, 678 bp, Homo sapiens
  misc_feature: 30653.44.27.C05.1.pb.heavy.1.raw 30653
gctcagacagtatataggaagtagtccttgaccaggcagcccagggccgctgtgctctcggaaggtgctcctggagccagggcgccagggggaagaccgatgggcccttggtggaggccgaggagacggtgaccagggttccctggccccaggtcctcgaatgaaccgatttggaacagatagtctcgcacaaaaatacacgccgtgtcctgaggtcctcaggctgttcatttgaagagaactgtgttctcggaaattgtctctggagatggtgaatcggcctcacggaatcaccgtagacttgattttcctccatgaaaatgacacacctgccacccactccagcccctcgcctggagcctggcgacccactgcatattccaattatcgaaggtgaatccagaggctgcacaggagagtctcaggaccccctactggggccacgcctccccagactccacgaattgcacctgacacatgacacctcttaagagggcaacgaggaaaacccagctcagcccaaaactcctggtgagtctctgtgttcatgatgatcacgagtggaaacaccggcgacttccagtgctgggctcgtctcccaggccccaaaccttcgatcgcgtctaaatcgagcaccggtcgtgtatatactgtctgaatgcgcgaggaggcgatacg

SEQ ID NO: 791434 - DNA, 700 bp, Homo sapiens
  misc_feature: 30715.44.55.E11.1.pb.heavy.1.raw 30715
cgtatcgcctccctcgcgccatcagacagtatatacacgaccggtgctcgatttagcactcgcacgttggtttggggagaggagcccagcactgggatccgaggtgtttccattcggtgatcagcactgaacacagaggactcaccatggagttttggctgagctgggttctccttgttggacttttaaaggtgtccagtgtgaggtgcggctgatggagtctggaggaggcttagtccaggcctgggggtcccagagactctcctgtgcggcctctgggctcaccgtcagcagcaactacatgagttgggtccgccaggctccagggaaggggctggagtgggtctcagtcatttatactggtgatttcacatactacgcagactccgtgaagggccgattcaccatctccaggcgacaattcaggaacacggtttatcttcaaatgaacaacctgagaggcgacgacacggccgtctattactgtgcgagacaagtcggcgctcggagtggttattattcgtttgacttctggggcagggaaccctggtcaccgtcgcctccgcctccaccaagggcccatcggtcttccccctggcaccctcctccaagagcacctctgggggcacagcggccctgggctgcctggttcaaggactacttcctatatactgtctgagcgggctggcaaggcgcataa

SEQ ID NO: 791435 - DNA, 675 bp, Homo sapiens
  misc_feature: 30757.44.35.D02.1.pb.heavy.1.raw 30757
cgtatcgcctccctcgcgccatcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcggcccaggacgggtgaagccttcggagaccctgtccctcacctgcaatgtctctggtggttacatcagtagttattattggagttggctgcggcagtccgccggaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcgaactggctcgacccctggggccagggaaccctggtcaccgtctcctcagcctccaccaagggcccatcggtcttcccctggcaccctcctccaagagcacctctggggcacagcggccctgggctgcctggtcaaggactacttcctatatactgtctgagcgggctggcaaggcgcatag

SEQ ID NO: 791436 - DNA, 613 bp, Homo sapiens
  misc_feature: 30774.UNK.UNK.UNK.pb.heavy.1.raw 30774
gagaaggctgggcaggctatgcaccctggtccaggtcaaaagctgcggaacccgctagcggccatcttggccactaggggtcccgcagattcatattgtcgtctagcatgcacaatgctgcaacccagcttgcaatgcccacagcaagcggccaatctttacgccacgttgaattgtttatttacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtggggggggtgataggggtggattctatttcctatcccatcccctaggatctcaattaagttactagcgagttaaatgtctgtagcgatcccggtcagtcctatcgccgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg
